(12) United States Patent
Phadnavis et al.

(10) Patent No.: US 8,999,683 B2
(45) Date of Patent: Apr. 7, 2015

(54) PRODUCTION OF BIODIESEL BY YEAST FROM LIGNOCELLULOSE AND GLYCEROL

(75) Inventors: Ambareesh Govind Phadnavis, Kgs. Lyngby (DK); Peter Ruhdal Jensen, Gentofte (DK)

(73) Assignee: Technical University of Denmark, Kgs. Lyngby (DK)

( * ) Notice: Subject to any disclaimer, the term of this patent is extended or adjusted under 35 U.S.C. 154(b) by 79 days.

(21) Appl. No.: 13/704,776

(22) PCT Filed: Jun. 20, 2011

(86) PCT No.: PCT/EP2011/060237
§ 371 (c)(1),
(2), (4) Date: Feb. 13, 2013

(87) PCT Pub. No.: WO2011/157848
PCT Pub. Date: Dec. 22, 2011

(65) Prior Publication Data
US 2013/0137149 A1    May 30, 2013

Related U.S. Application Data

(60) Provisional application No. 61/356,344, filed on Jun. 18, 2010.

(30) Foreign Application Priority Data

Jul. 16, 2010   (EP) .................................... 10169839

(51) Int. Cl.
| | | |
|---|---|---|
| C12N 15/81 | (2006.01) | |
| H04W 28/18 | (2009.01) | |
| H04W 72/08 | (2009.01) | |
| H04W 92/04 | (2009.01) | |
| H04W 92/12 | (2009.01) | |

(52) U.S. Cl.
CPC ............. *C12N 15/815* (2013.01); *H04W 28/18* (2013.01); *H04W 92/045* (2013.01); *H04W 92/12* (2013.01); *H04W 72/08* (2013.01); *C12N 15/81* (2013.01)

(58) Field of Classification Search
CPC ...................................................... C12N 15/70
USPC .............................................. 435/134, 254.3
See application file for complete search history.

(56) References Cited

FOREIGN PATENT DOCUMENTS

| EP | 1273664 A1 | 1/2003 |
|---|---|---|
| WO | 2007136762 A2 | 11/2007 |
| WO | 2008080124 A2 | 7/2008 |
| WO | 2008113041 A2 | 9/2008 |
| WO | 2008121701 A1 | 10/2008 |
| WO | 2009143495 A2 | 11/2009 |

OTHER PUBLICATIONS

Oberländer. Pathways for phospholipid deacylation in *Saccharomyces cerevisiae* and their impact on fatty acid trafficking and equilibrium. Ph.D. thesis, 2010.*
Tehlivets et al., Fatty acid synthesis and elongation in yeast. Biochimica et Biophysica Acta 1771: 255-270, 2007.*
ISR and Written Opinion issued in related PCT Application No. PCT/EP2011/060237, 2011.
Michinaka et al., "Extracellular Secretion of Free Fatty Acids by Disruption of a Fatty Acyl-CoA Synthetase Gene in *Saccharomyces cerevisiae*", Journal of Bioscience and Bioengineering, vol. 95 (5), pp. 435-440 (2003).
Nojima et al., "Isolation and Characterization of Triacylglycerol-secreting Mutant Strain from Yeast, *Saccharomyces cerevisiae*", J. Gen. Appl. Microbiol., vol. 45(1), pp. 1-6 (1999).
Miyakawa et al., "Isolation and Characterization of a Mutant of *Candida lipolytica* Which Excretes Long-chain Fatty Acids", Agric. Biol. Chem., vol. 48(2), pp. 499-503 (1984).
Lennen et al., "A Process for Microbial Hydrocarbon Synthesis: Overproduction of Fatty Acids in *Escherichia coli* and Catalytic Conversion to Alkanes", Biotechnology and Bioengineering, vol. 106(2), pp. 193-202 (2010).
J.L. Fortman et al., "Biofuel Alternatives to Ethanol: Pumping the Microbial Well", Trends in Biotechnology, vol. 26(7), pp. 375-381 (2008).
Johnson et al., "Genetic Analysis of the Role of *Saccharomyces cerevisiae* Acyl-CoA Synthetase Genes in Regulating Protein N-Myristoylation", Journal of Biological Chemistry, 269(27), pp. 18037-18046 (1994).
Knoll et al., "Biochemical Studies of Three *Saccharomyces cerevisiae* Acyl-CoA Synthetases, Faa1p, Faa2p, and Faa3p", Journal of Biological Chemistry, vol. 269(23), pp. 16348-16356 (1994).
Tehlivets et al., "Fatty Acid Synthesis and Elongation in Yeast", Biochimica et Biophysica Acta, vol. 1771(3), pp. 255-270 (2007).
Wang et al., "Oleaginous Yeast *Yarrowia lipolytica* Mutants with a Disrupted Fatty Acyl-CoA Synthetase Gene Accumulate Saturated Fatty Acid", Process Biochemistry, vol. 46(7), pp. 1436-1441 (2011).
Waks et al., "Engineering a Synthetic Dual-Organism System for Hydrogen Production", Applied and Environmental Microbiology, vol. 75(7), pp. 1867-1875 (2009).

* cited by examiner

*Primary Examiner* — Tekchand Saidha
*Assistant Examiner* — Rama P Ramanujam
(74) *Attorney, Agent, or Firm* — Michael Best & Friedrich LLP

(57) ABSTRACT

The invention is directed to a genetically modified microorganism for the extracellular production of free fatty acids and esters thereof, wherein said microorganism is characterized by a modified lipid biosynthesis metabolic pathway: for example reduced fatty acyl-coA synthetase activity that enables the microorganism to overproduce and secrete of esters of fatty acids (Biodiesel) into the surrounding medium, using one or more of: glucose, starch, lignocellulose and a glycerol-based substrate, as a carbon source. The invention further provides a method for the extracellular production of free fatty acids and esters thereof, comprising the use of said genetically modified organism, and a growth medium adapted for said method.

14 Claims, 17 Drawing Sheets

Figure 1A:
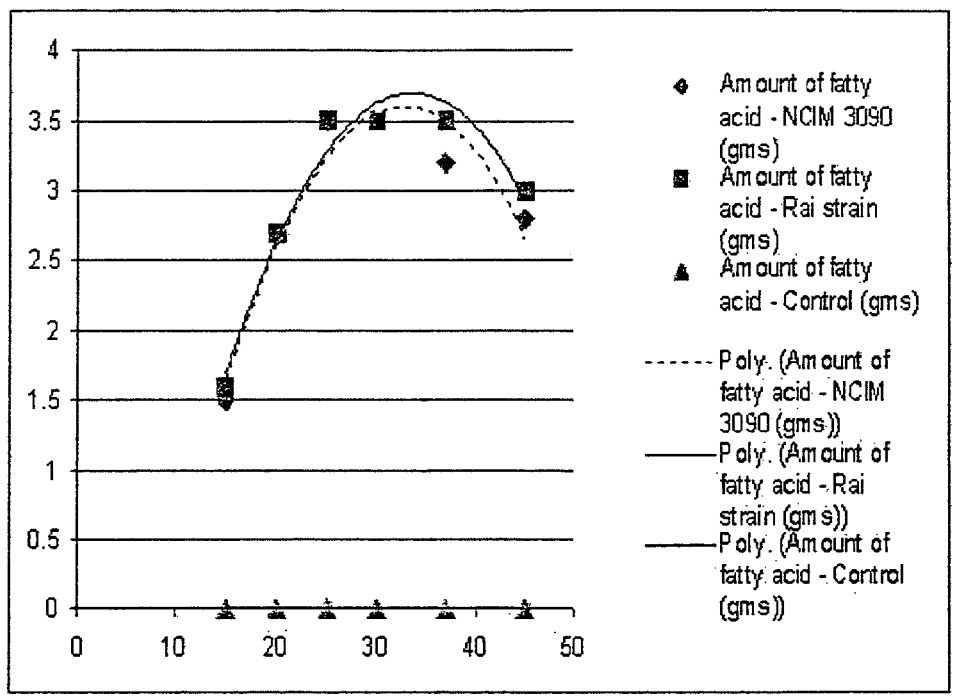

Deletion of FAA2 –
Downregulation of fatty
acid oxidation pathway

Lane 1 2 3 4 5

Lanes:  M    1    2    3    4    M

M      1      2      3      4 Lane

PRODUCTION OF BIODIESEL BY YEAST FROM LIGNOCELLULOSE AND GLYCEROL

CROSS-REFERENCE TO RELATED APPLICATIONS

This is the U.S. national stage entry of International Patent Application No. PCT/EP2011/060237, filed on Jun. 20, 2011, which claims priority to European Patent Application No. EP 10169839.7, filed on Jul. 16, 2010 and U.S. Provisional Patent Application No. 61/356,344, filed on Jun. 18, 2010, the contents of all of which are herein fully incorporated by reference.

FIELD OF THE INVENTION

The invention relates to modifying the lipid biosynthesis metabolic pathway in yeast by genetic engineering in order to overproduce and secrete esters of fatty acids (Biodiesel) into the medium, using one or more of: glucose, starch, lignocellulose and a glycerol-based substrate, as a carbon source.

BACKGROUND OF THE INVENTION

Biodiesel refers to a fuel comprised of mono-alkyl esters of long chain fatty acids derived from vegetable oils or animal fats, designated B100, and meeting the requirements of ASTM D 6751. Currently, the most common method of Biodiesel production is trans-esterification of edible and non-edible vegetable oils, or sometimes animal fats. The trans-esterification reaction transforms triglycerides into fatty acid alkyl ester, in the presence of an alcohol, such as methanol or ethanol, and a catalyst, such as an alkali or acid, where glycerol is a by-product. Biodiesel has a comparable cetane rating and energy content to petro-diesel and hence is considered to be a perfect substitute to petro-diesel. It can either be used in pure from (100%) or is blended with petro-diesel is varying proportions. Soybean and Rapeseed are a common source of vegetable oils for biodiesel production. Such vegetable oils are in the form of triglycerides, which then need to be degraded to free-fatty acids and glycerol, where the fatty acids are esterified either chemically or enzymatically by the process known as 'transesterification'. This poses an enormous strain on available arable land for production of both food-crops and fuel-crops, thereby exerting an undesirable pressure on food prices. Furthermore, since oil-seeds are a seasonal crop, once the crop is harvested and utilized, one has to wait until the next harvest is ready. Accordingly, their exits a need to overcome the food-OR-fuel dilemma, as well as a continuing need to shift global energy consumption from fossil fuels to environment-friendly biofuels. A further goal is to exploit energy sources such as cheap carbon sources which are by-products of established biodiesel Industry (Glycerol), as well as the most abundant non-edible sugar-sources available in nature, namely lignocellulose. The use of non-starch carbon sources such as cellulose, hemicelluloses, xylose, and lignin will not only favour the economics of bulk production of biodiesel, but will also reduce the strain on agricultural resources needed to satisfy society's need for food.

Although attempts have been made to manipulate microbial organisms biodiesel production, a principal barrier to success has been the development of robust, high-yielding microbes and processes for their production

SUMMARY OF THE INVENTION

The present invention is directed to a genetically modified microorganism for the extracellular production of free fatty acids and esters thereof, wherein said microorganism characterised by: reduced fatty acyl-coA synthetase activity conferred by one or more of: FAA2 gene deletion; deletion of any one of a FAA1 gene, FAA3 gene and FAA4 gene; recombinant endogenous FAA 1 gene, FAA3 gene or FAA4 gene, wherein said gene is operably linked to a heterologous promoter; and/or enhanced acetyl CoA carboxylase expression conferred by: a recombinant endogenous ACC1 gene wherein said gene is operably linked to a heterologous promoter. For example, said microorganism is selected from among species of *Aspergillus, Candida, Cryptococcus, Debaryomyces, Fusarium, Lindnera, Lipomyces, Monascus, Mucor, Pachysolen, Pichia; Rhizopus, Rhodosporidium; Rhodotorula, Saccharomyces; Schizosacchromyces; Trichosporon, Yarrowia,* and *Zygosacchromyces*. Preferably the genetically modified organism is a *Saccharomyces*, in particular *S. cerevisiae*.

In one embodiment the genetically modified microorganism is characterised by a recombinant endogenous ACC1 gene that is operably linked to a TEF1 promoter from yeast [SEQ ID NO: 113].

In one embodiment the genetically modified microorganism is characterised by comprising a transgene encoding a pyruvate formate lyase comprising PflA and PflB.

The genetically modified microorganism comprising either a FAA2 deletion (or a FAA1, FAA3 or FAA4 deletion), or a recombinant endogenous ACC1 gene that is operably linked to a heterologous promoter, may be characterised by additionally comprising the transgene encoding a pyruvate formate lyase comprising PflA and PflB.

The genetically modified microorganism may be further characterised by additionally comprising a transgene encoding an acyl CoA-ACP thioesterase, wherein said thioesterase is selected from among: Soyabean (*Glycine max*); *Chlamydomonas reinhardtii* (Protein ID—A8HY17); *Arabidopsis thaliana* (Protein ID—Q9SJE2); *Ricinus communis* (Protein ID—B9RAC3); *Triticum aestivum*; CtFatA from *Brassica napus* (Protein ID—Q43745); CtFatA from *C. tinctorius* (Protein ID—Q42715); GmFatA1 from *G. mangostana* (Protein ID—O04792); CwFatB1 from *C. hookeriana* (Protein ID—Q39513); CwFatB1 from *C. wrightii* (Protein ID—Q39662); GmFatB1 from *G. Mangostana* (Protein ID—O04794).

The genetically modified microorganism, may be further characterised by additionally comprising enhanced expression of an acyl-coenzymeA:ethanol O-acyltransferase conferred by a recombinant endogenous acyl-coenzymeA:ethanol O-acyltransferase (EEB1) gene wherein said gene is operably linked to a heterologous promoter.

The genetically modified microorganism may be further characterised by additionally comprising a transgene encoding a heterologous cytosolic Acyl CoA thioesterase (CTE-1), wherein said CTE-1 is selected from among: *Mus muscilis* (Protein ID—O55137); *Arabidopsis thaliana* (Protein ID—Q5FYU1) or *Rattus norvegicus* (Protein ID—Q6AZ44)

The genetically modified microorganism may be further characterised by additionally comprising one or more transgene encoding a heterologous glycerol kinase or a xylose isomerase or both; wherein said glycerol kinase is selected from among Glycerol Kinase from *Saccharomyces cerevisiae* (Protein ID—P32190), and said xylose isomerise is selected from among Xylose isomerase from *Clostridium phytofermentas* (Protein ID—A9KN98); *Yersinia pestis*—(Protein ID—Q8Z9Z1).

The genetically modified microorganism may be further characterised by additionally comprising a deletion of an endogenous formate dehydrogenase FDH gene wherein said FDH gene is selected from among: GeneID: 854570; GeneID: 8300341; and GeneID: 2907923.

The genetically modified microorganism may be further characterised by additionally comprising a transgene encoding a heterologous formate hydrogen lysase, where said lyase is E. coli formate hydrogen lyase (Protein ID—C8UET5)

The genetically modified microorganism may be further characterised by additionally comprising a deletion of an endogenous alcohol dehydrogenase (ADH) gene, wherein said ADH gene is selected from among: GeneID: 854068; GeneID: 2538902; GeneID: 2868277; and GeneID: 852442.

The present invention is also directed to the use of a yeast or fungal strain for the extracellular production of free fatty acids and esters thereof, wherein said yeast or fungal strain is selected from among: Candida tropicalis, Pachysolen tannophilus, a FAA2 deletion strain of yeast, and a yeast or fungal strain according to any one of the above described genetically modified microorganism.

The present invention is also directed to a method for the extracellular production of free fatty acids and esters thereof, comprising the steps of: a) introducing a microorganism yeast or fungal strain into a growth medium to produce a culture; b) incubating said culture, wherein the growth medium in said culture is aerated with oxygen; c) further incubating said culture after step (b) in the absence of an oxygen supply; d) recovering an extracellular phase comprising free fatty acids and esters from said culture; wherein said microorganism is a yeast or fungal strain.

The method may further use a microorganism selected from among Candida tropicalis, Pachysolen tannophilus or any of the above described genetically modified microorganism.

In one embodiment the growth medium of the method comprises a carbon source is selected from at least one of glucose, glycerol, xylose, hydrolysed cellulose and hemicellulose, starch, sugar alcohol and xylan, Preferably the growth medium comprises or consists of the components set out below.

The present invention is also provides a growth medium adapted for use in the above described method, wherein the medium the composition comprises the following components,

| Component | Composition (grams/liter) |
|---|---|
| Carbon Source | |
| carbon source | ≥50 g |
| Nitrogen Source | |
| Ammonium sulphate | 5 g |
| Vitamins* | |
| Biotin | 20 μg |
| Folic acid | 2 μg |
| Inositol | 10 mg |
| Niacin | 400 μg |
| Riboflavin | 200 μg |
| Pyridoxine hydrochloride | 400 μg |
| Thiamine hydrochloride | 400 μg |
| Compounds supplying trace elements | |
| Boric acid | 500 μg |
| Copper sulphate | 40 μg |
| Potassium iodide | 100 μg |
| Ferric chloride | 200 μg |
| Manganese sulphate | 400 μg |
| Sodium molybdate | 200 μg |
| Zinc sulphate | 400 μg |

-continued

| Component | Composition (grams/liter) |
|---|---|
| Salts | |
| Potassium phosphate monobasic | 900 mg |
| Potassium phosphate dibasic | 200 mg |
| Magnesium sulphate | 500 mg |
| Sodium chloride | 100 mg |
| Calcium chloride | 100 mg | and wherein said carbon source is selected from among glucose, glycerol, xylose, hydrolysed cellulose and hemicellulose, starch, sugar alcohol and xylan.

DETAILED DESCRIPTION OF THE INVENTION

Figures

FIG. 1a: Saponifiable fatty acid content of two yeast strains (Y axis) as a function of fermentation growth temperature (X-axis). Note that the values of control reading are on X axis with Y co-ordinate as zero throughout the experiment.

Figure 1B:
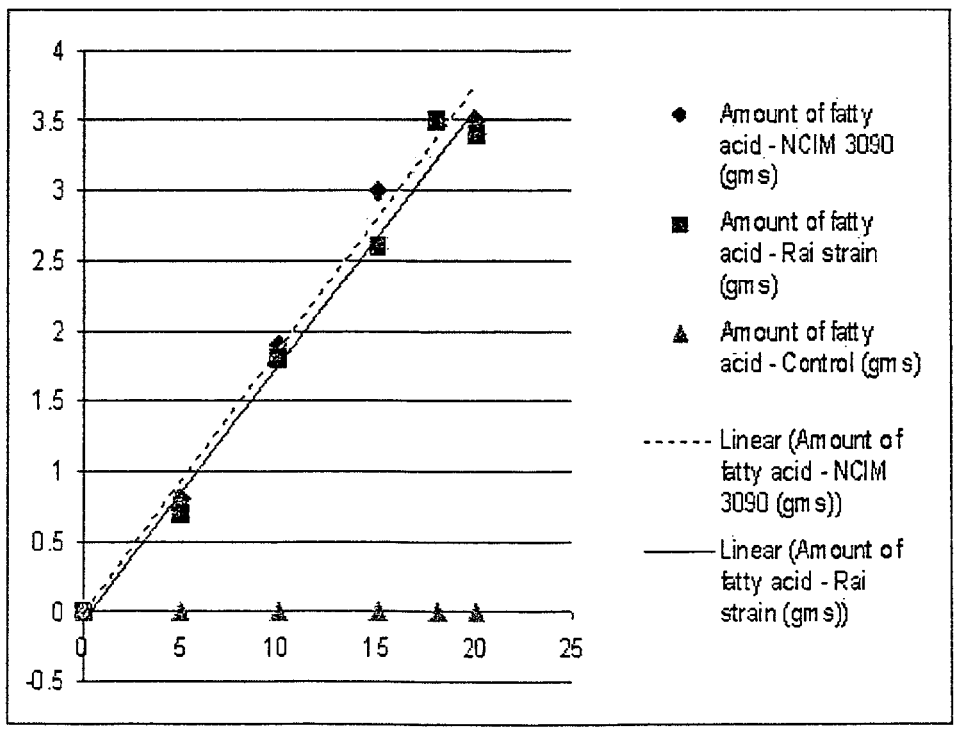

FIG. 1b: Saponifiable fatty acid content of two yeast strains (Y axis) as a function of glucose concentration (X-axis). The relationship is linear passing through origin, however, due to practical difficulties, the trend was discontinued beyond X=20.

Figure 1C:
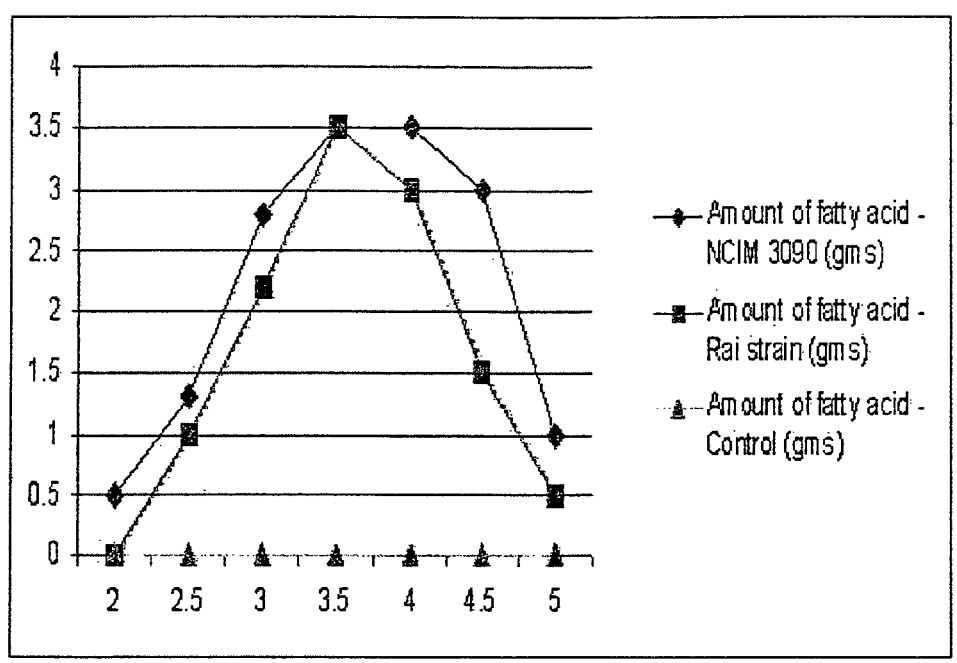
Figure 2:
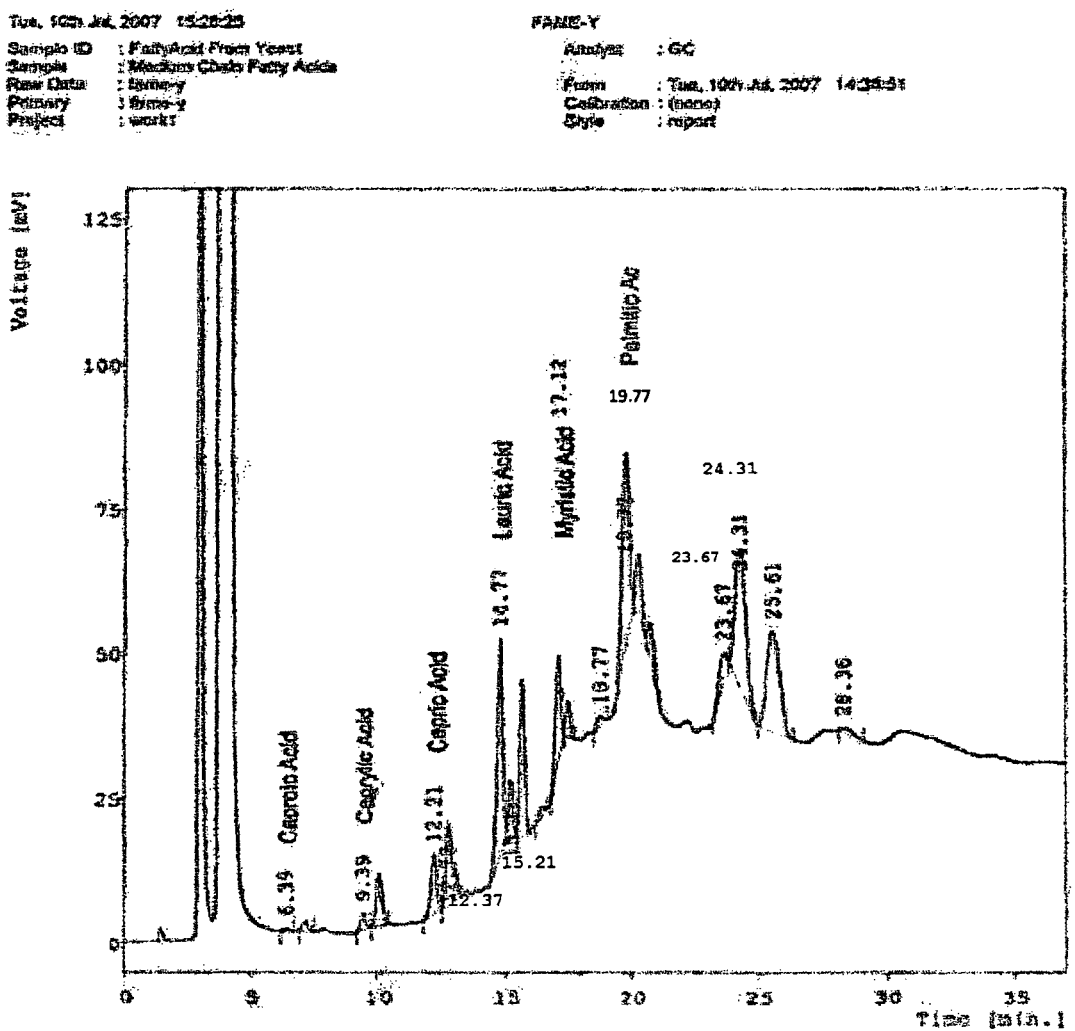

FIG. 1c: Saponifiable fatty acid content of the fermentation medium of two yeast strains (Y axis) as a function of pH values (X-axis). The trend is roughly a Bell Shaped curve FIG. 2: Gas Chromatogram of methyl esters of fatty acids secreted into the medium by yeast strain Saccharomyces cerevisiae (Wild type).

Figure 3A:
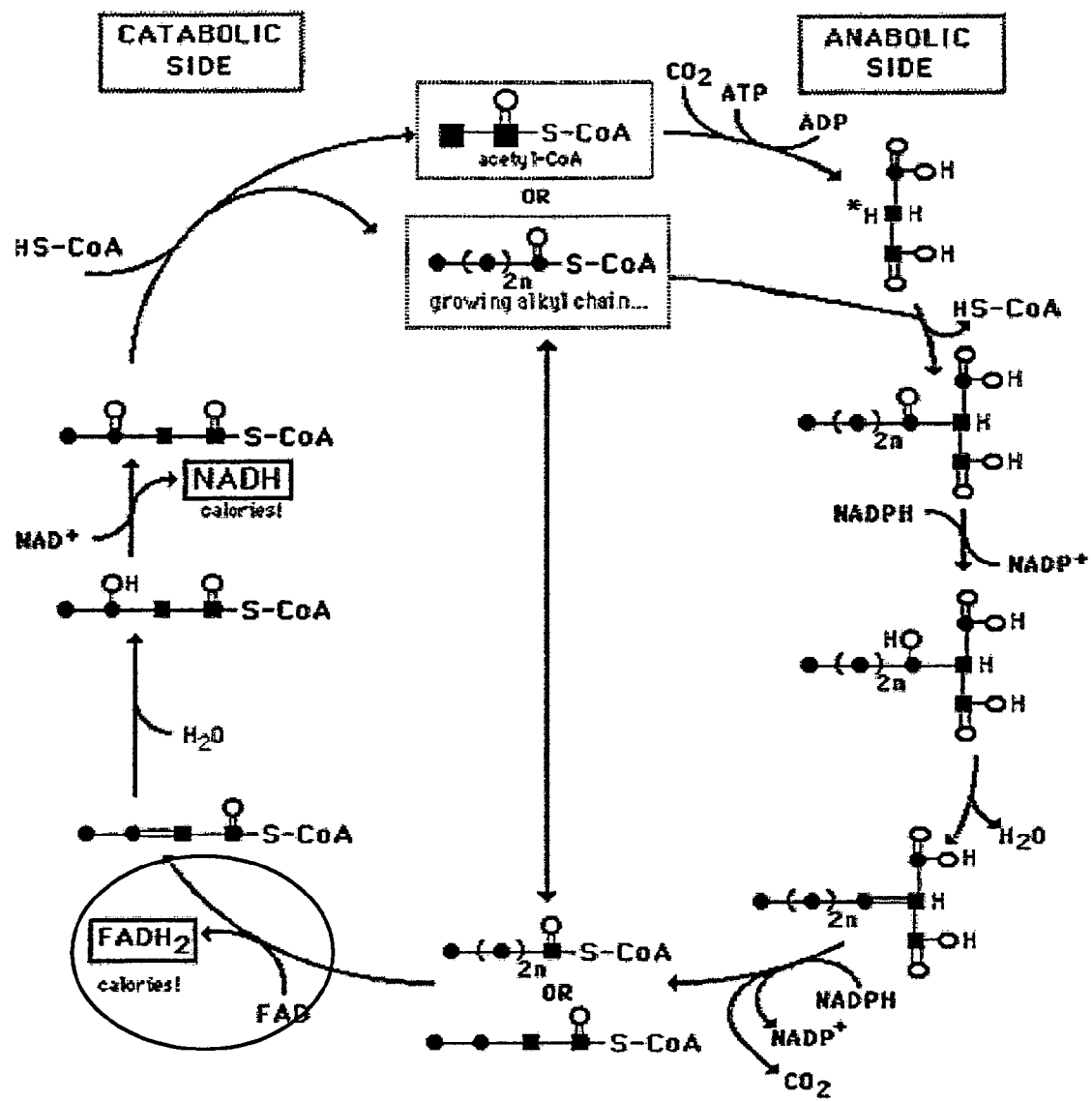
Figure 3B:
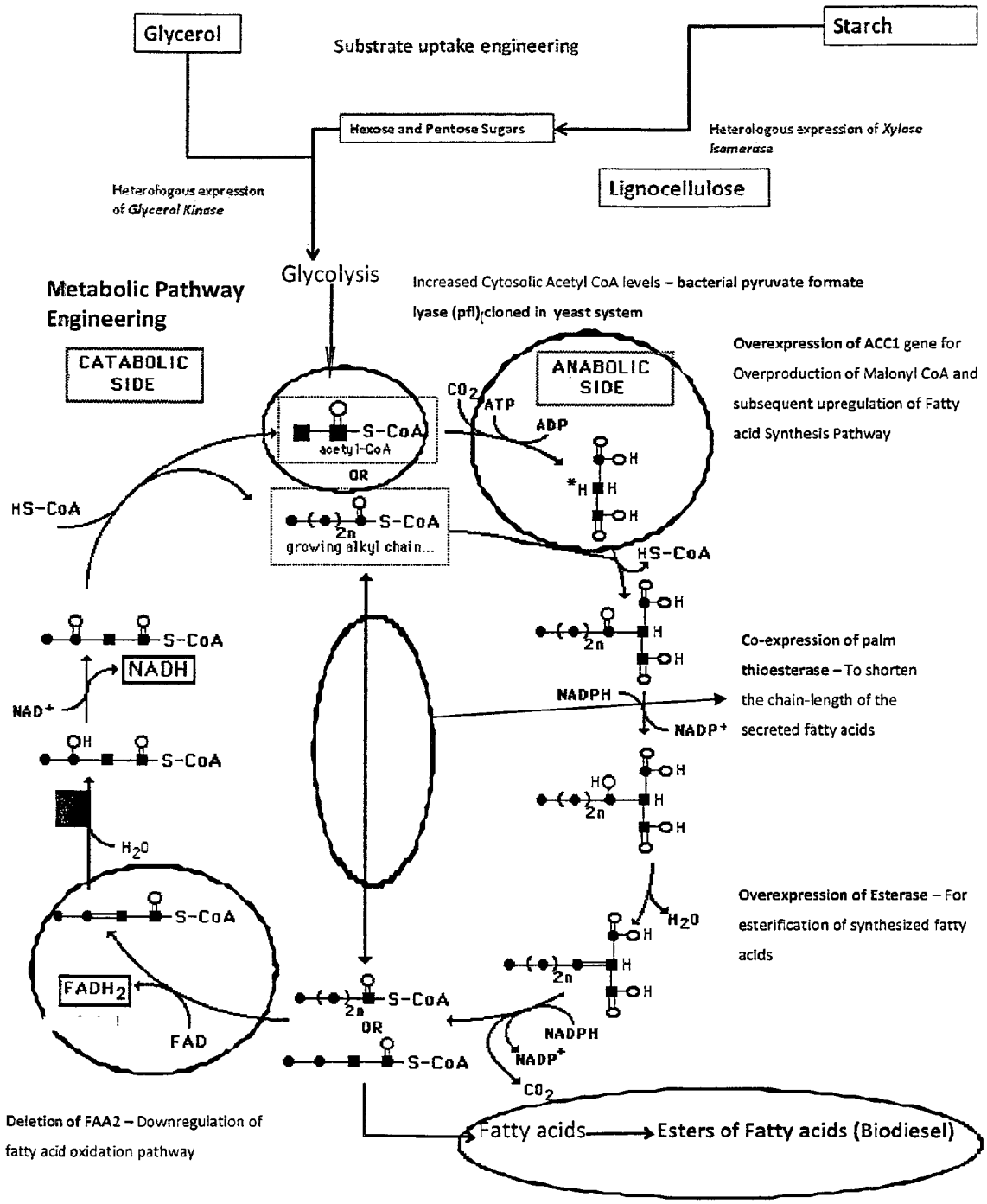

FIG. 3: Lipid metabolic cycle in yeast. a) FAA2 is one of the enzymes in the repertoire of Saccharomyces cerevisiae which catalyzes the first step involved in catabolism of fatty acids; b) manipulation of the lipid metabolism in yeast.

Figure 4:
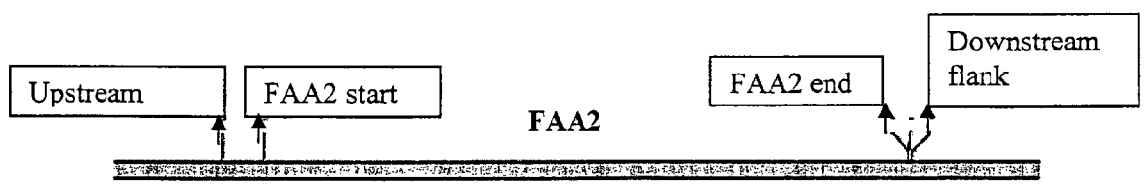

FIG. 4: The deleted portion of FAA2. 145 bp upstream and 60 bp downstream of the gene were deleted and replaced with URA3

Figure 5:
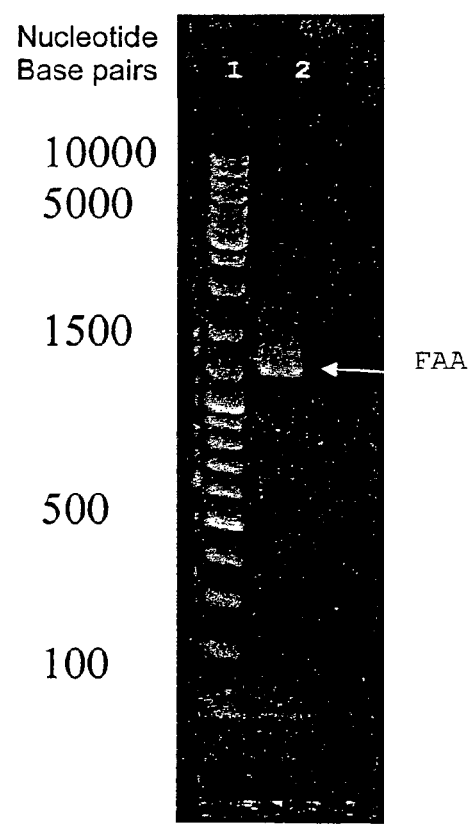

FIG. 5: SDS-gel with PCR amplification products of FAA2 from WT genome. Lane 1: DNA size marker:100-10,000 nucleotide base pairs; Lane 2: PCR product of WT yeast genomic DNA amplification using primer pair 3 (Table 4).

Figure 6A:
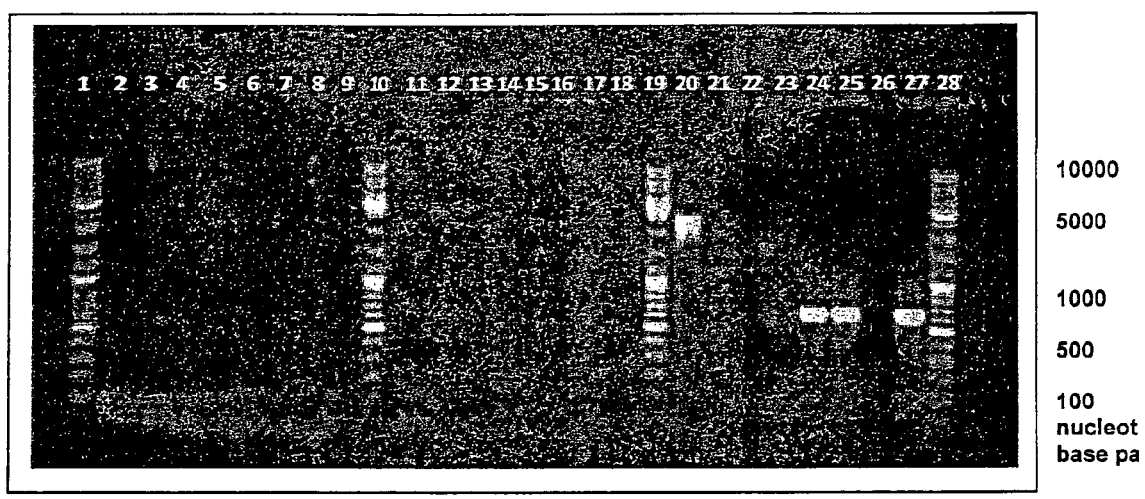
Figure 6B:
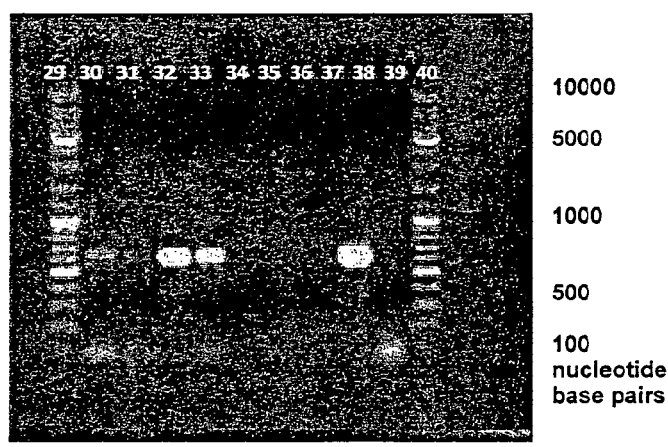

FIG. 6a,b: Detection of FAA2 (Δura3) deletion in gDNA from transformed yeast colonies. Wells 3-9, 11-17 contain genomic DNA from transformed yeast colonies, amplified with FAA2 primer set 3. Wells 18, 20-27, 30-33 contain genomic DNA from transformed yeast colonies, amplified with URA3 primer set 2. Wells 1, 10, 19, 28, 29, 40 contain DNA size ladders. Well number 2 and 39 contained WT-DNA amplified with primer set 3 and primer set 2 respectively. Well 38 contain URA3 plasmid amplified with primer set 2, as positive control.

Figure 7:
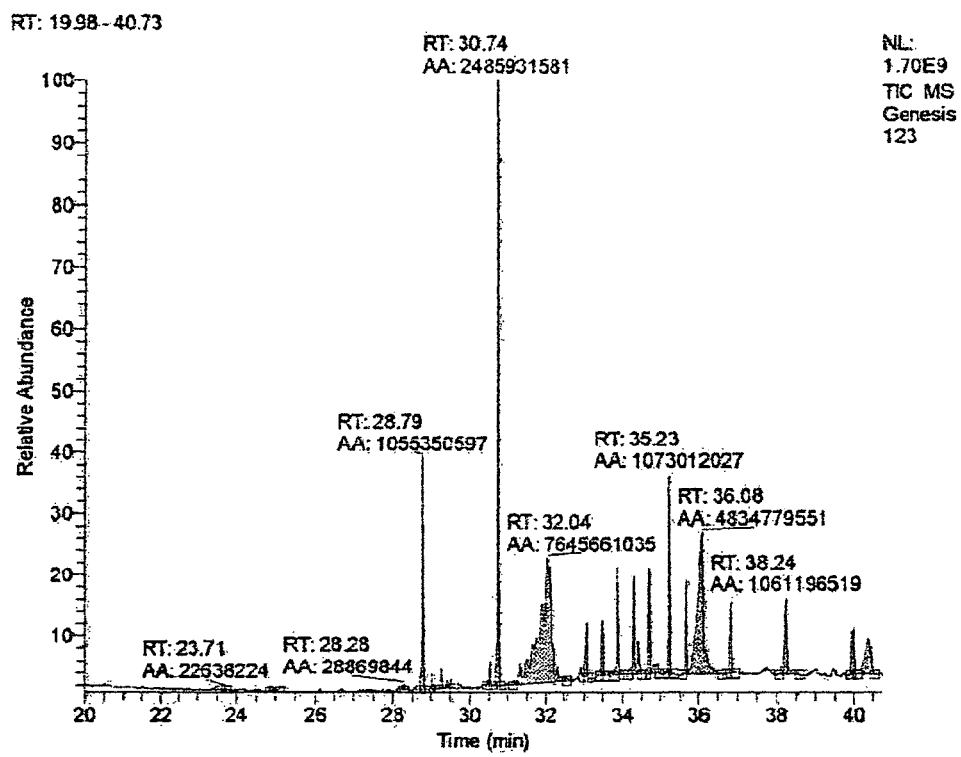

FIG. 7: GC-MS graph of extracellular fatty acids secreted by from WT-strain (S. cerevisiae) grown on glucose medium.

Figure 8:
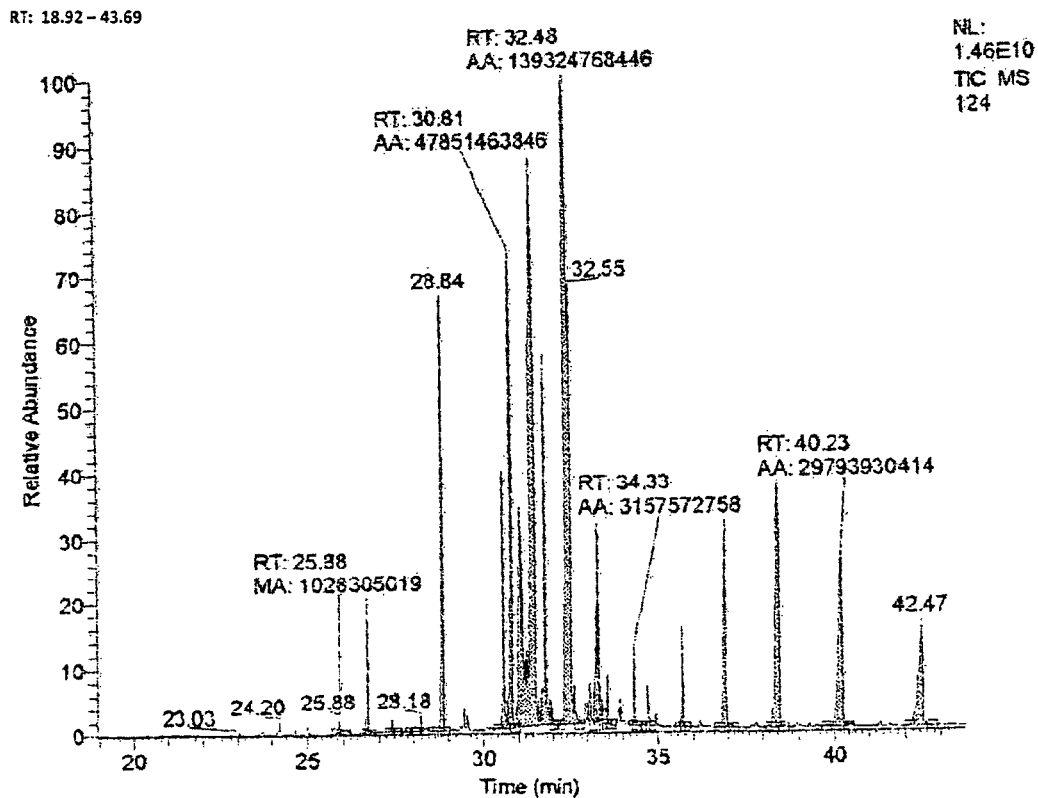

FIG. 8: GC-MS graph of intracellular fatty acids secreted by from WT-strain (S. cerevisiae) grown on glucose medium.

Figure 9:
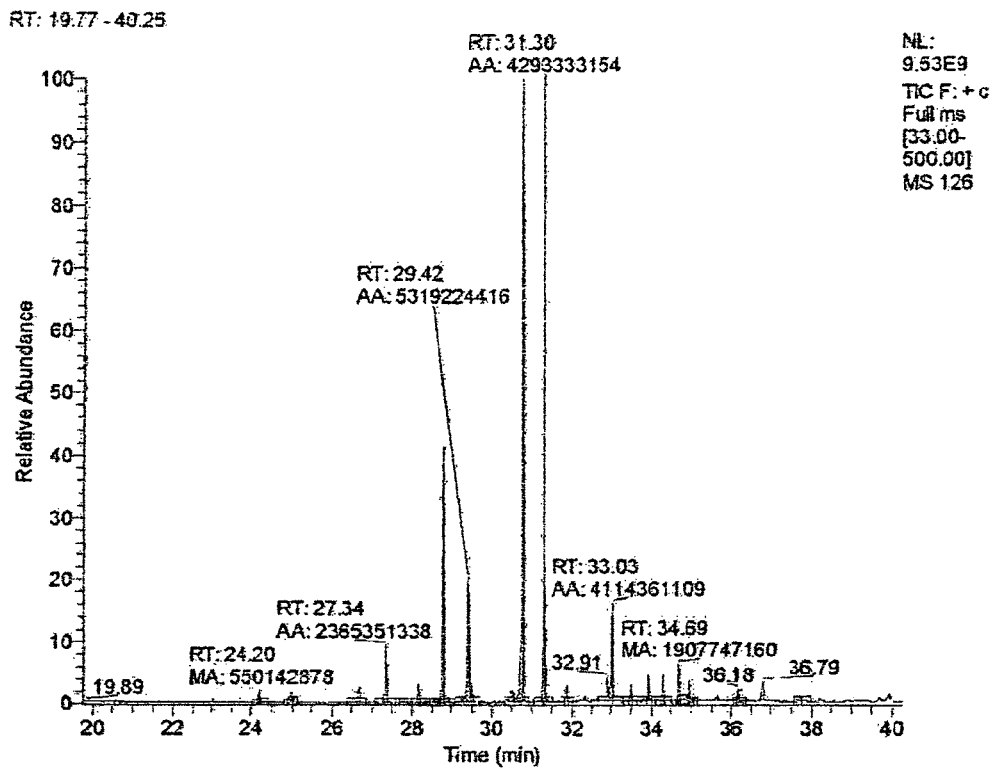

FIG. 9: GC-MS graph of extracellular fatty acids by FAA2 (Δura3) deletion mutant of WT-strain (S. cerevisiae FAA2 Δura3) grown on glucose medium.

Figure 10:
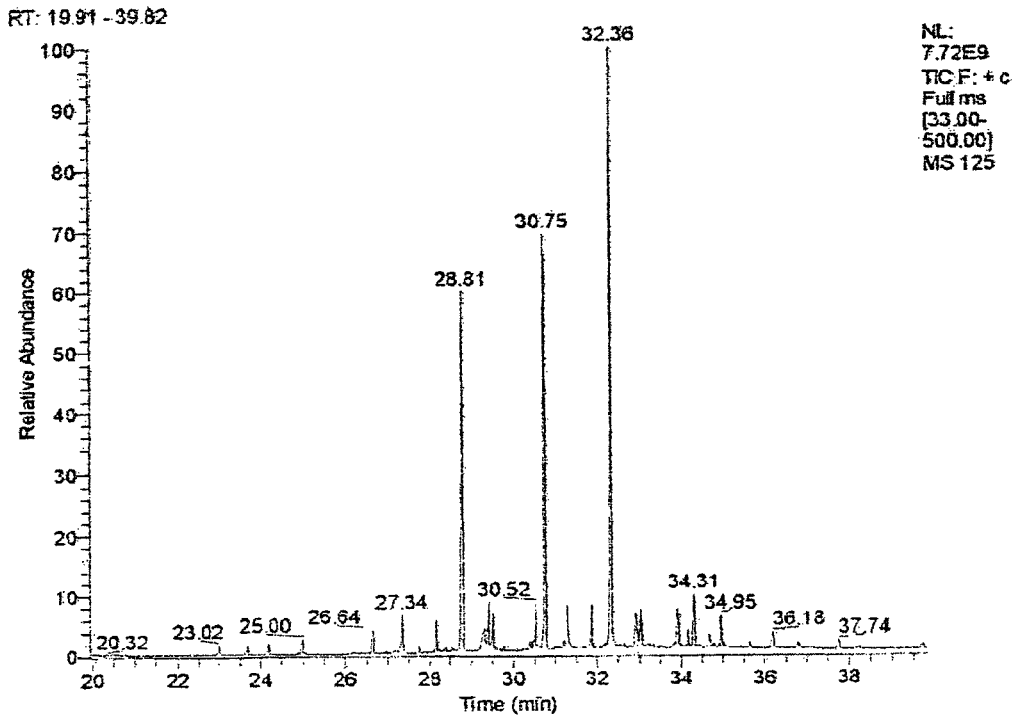

FIG. 10: GC-MS graph of intracellular fatty acids by FAA2 (Δura3) deletion mutant of WT-strain (S. cerevisiae FAA2 Δura3) grown on glucose medium.

Figure 11:
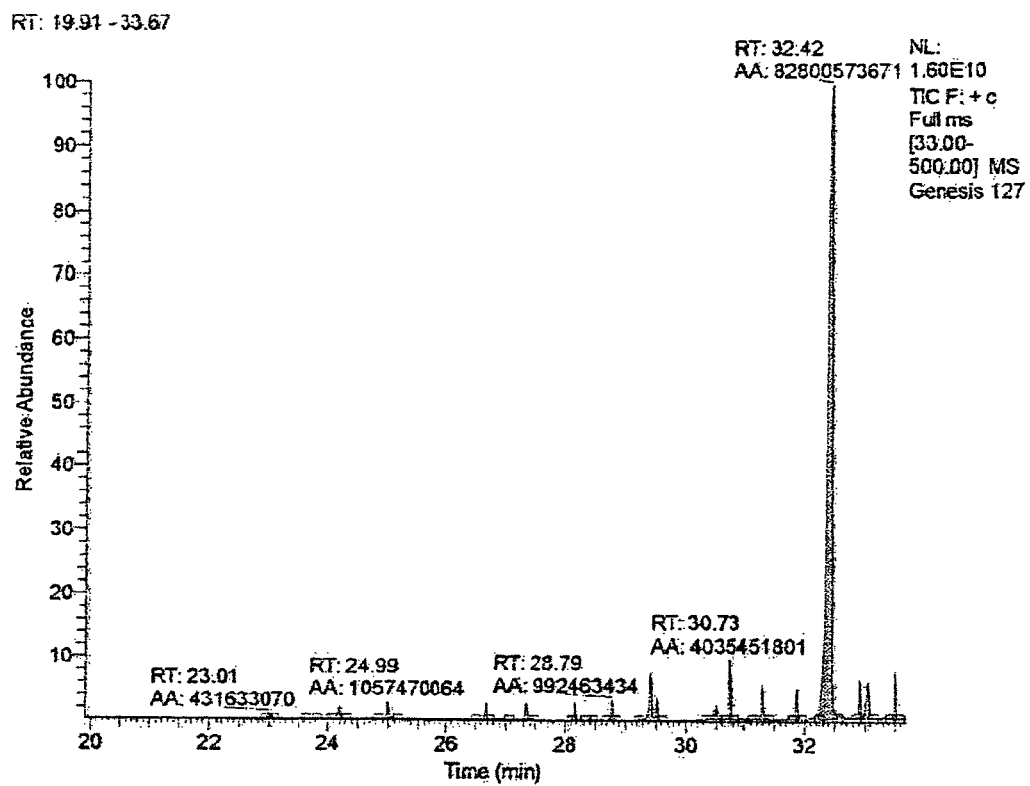

FIG. 11: GC-MS graph of extracellular fatty acids secreted by from WT-strain (S. cerevisiae) grown on glycerol medium.

Figure 12:
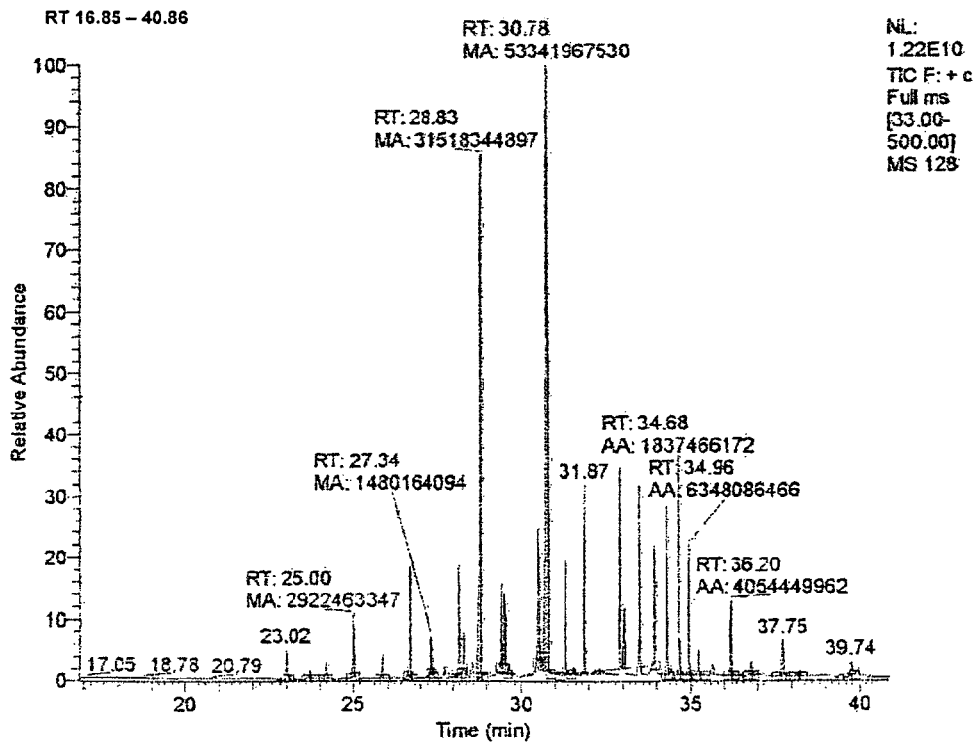

FIG. 12: GC-MS graph of extracellular fatty acids by FAA2 (Δura3) deletion mutant of WT-strain (*S. cerevisiae* FAA2 Δura3) grown on glycerol medium.

Figure 13:
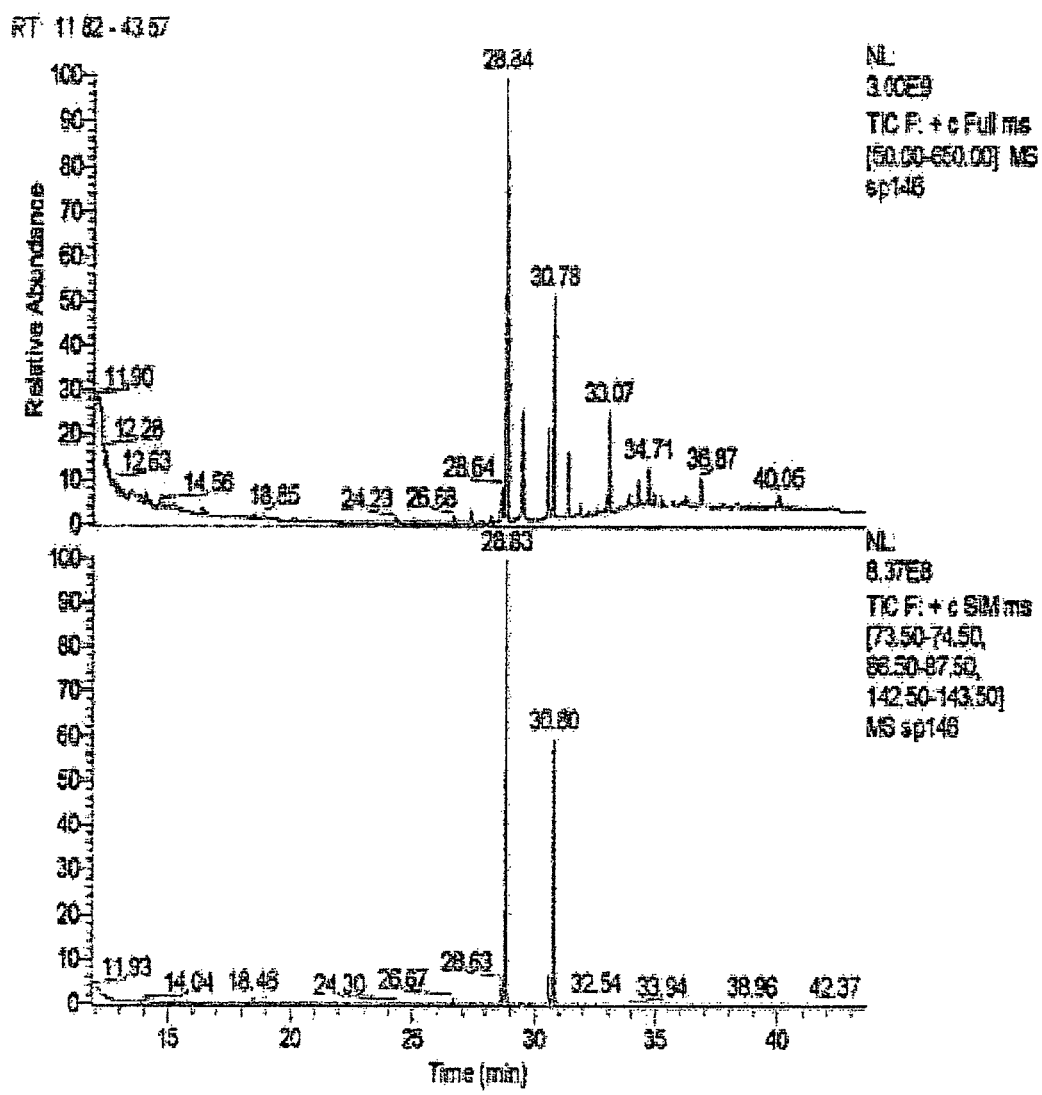

FIG. 13: GC-MS graph of extracellular fatty acids by *Candida tropicalis* grown on glucose medium (upper panel); fatty acid standards (lower panel).

Figure 14:
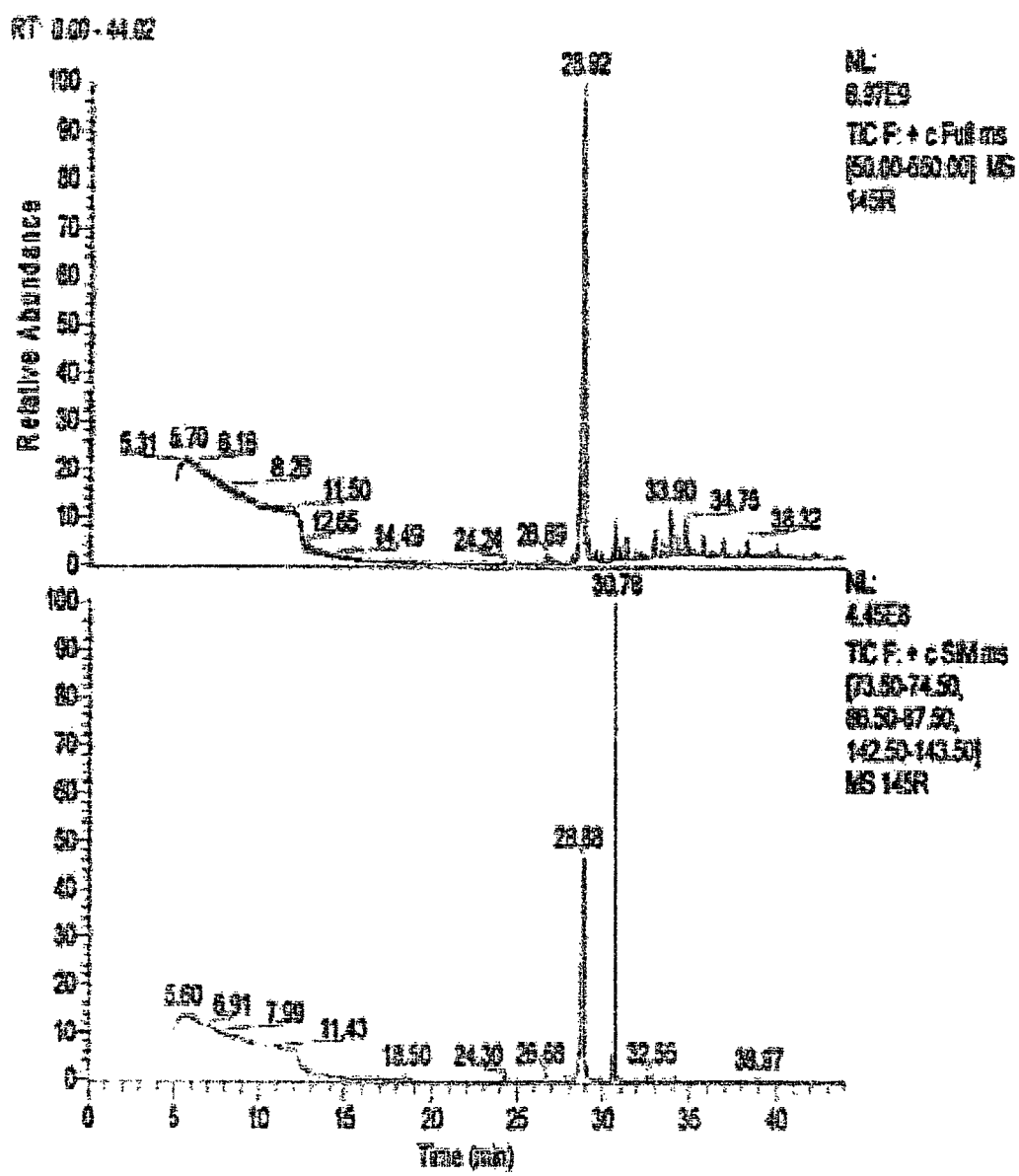

FIG. 14: GC-MS graph of extracellular fatty acids by *Candida tropicalis* grown on glycerol medium (upper panel); fatty acid standards (lower panel).

Figure 15:
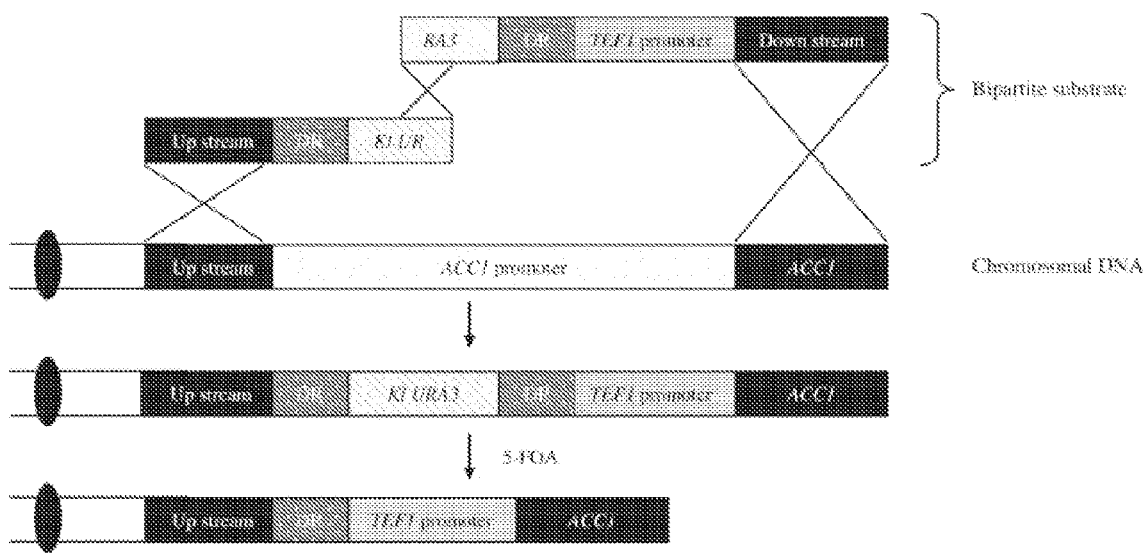

FIG. 15: The homologous recombination of upstream and downstream sequences from the bipartite gene-targeting substrate to the chromosomal locus results in the exchange of ACC1 promoter to TEF1 promoter and the insertion of KI URA3 flanked by direct repeats (DR). The KI URA3 was later removed by plating the strains on medium containing 5-fluoroorotic acid (5-FOA).

Figure 16:
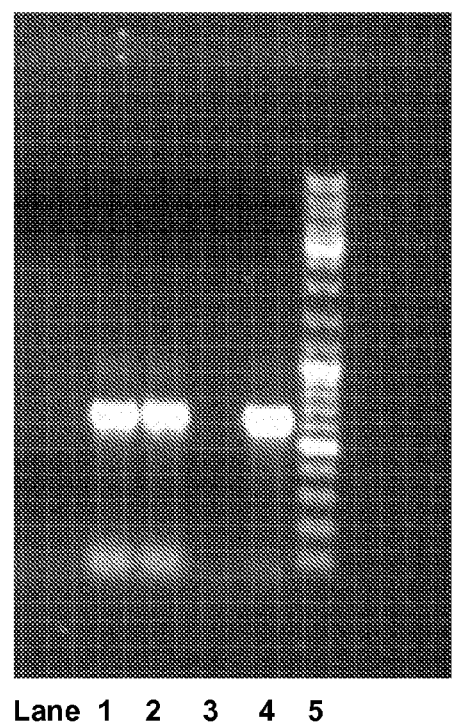

FIG. 16: PCR detection of FAA2 (Δura3) deletion in gDNA from transformed SC-ACC1 yeast colonies. Gel in which lanes 1-4 contain genomic DNA from transformed yeast colonies, amplified with FAA2 primer set 3 and URA3 primers respectively, and demonstrate presence of URA3 and absence of FAA2 in the gDNA in mutants in Lanes 1, 2 and 4. Lane 5 contains a DNA size ladder.

Figure 17:
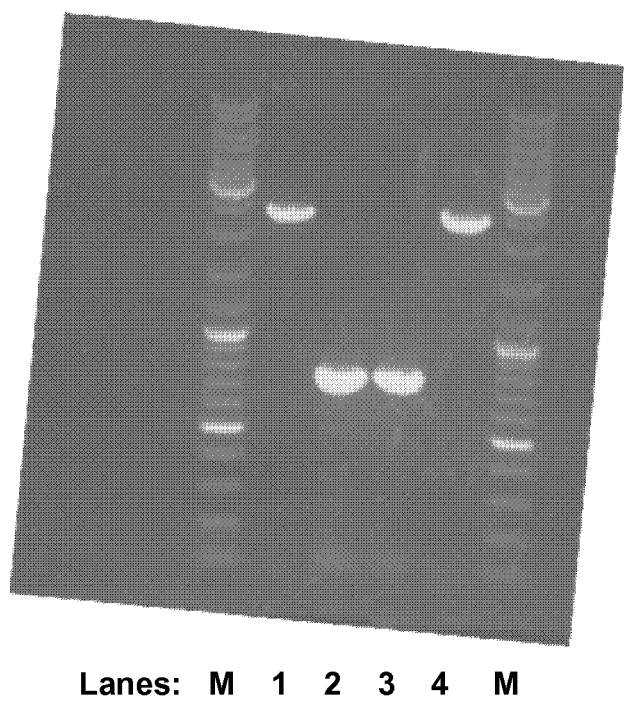

FIG. 17: PCR detection of *E. coli* pyruvate formate lyase A gene (in lane 1 and 4) and Pyruvate Formate lyase B gene (in lane 2 and 3) amplified from *E. coli* genome, amplified with pflA and pflB specific primers. Lane M contains a DNA size ladder.

Figure 18:
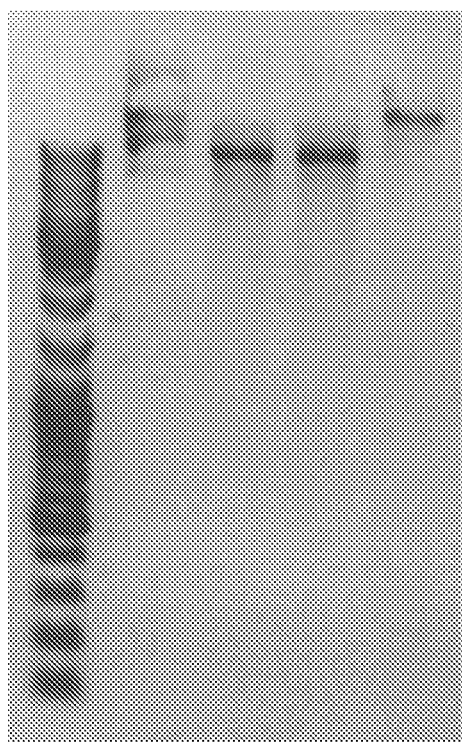

FIG. 18: Gel Photograph showing plasmid (in lane 2 and 3) and ligated plasmid (in lane 1 and 4). The lane 1 is PflA gene in shuttle vector PCM182. The lane 4 is PFLB gene in shuttle vector PCM183. Lane M contains a DNA size ladder.

Figure 19:
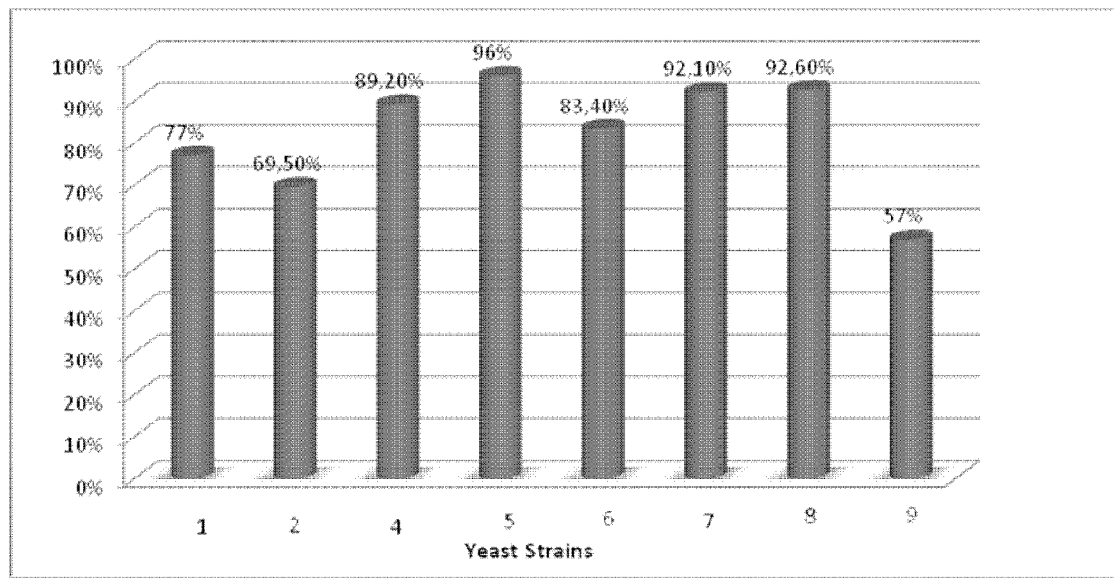

FIG. 19: Comparative fatty acid yield of yeast strains of invention when grown on 20% glucose as carbon source.

Figure 20:
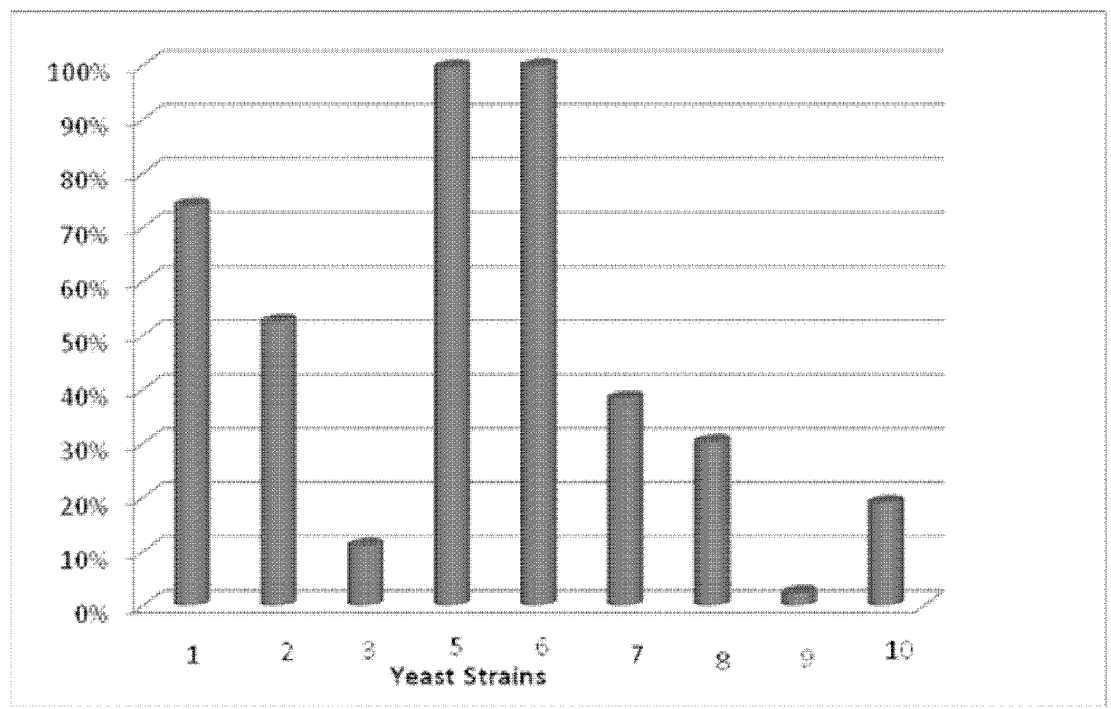

FIG. 20: Comparative fatty acid yield of yeast strains of invention when grown 5% pure glycerol as carbon source.

Figure 21:
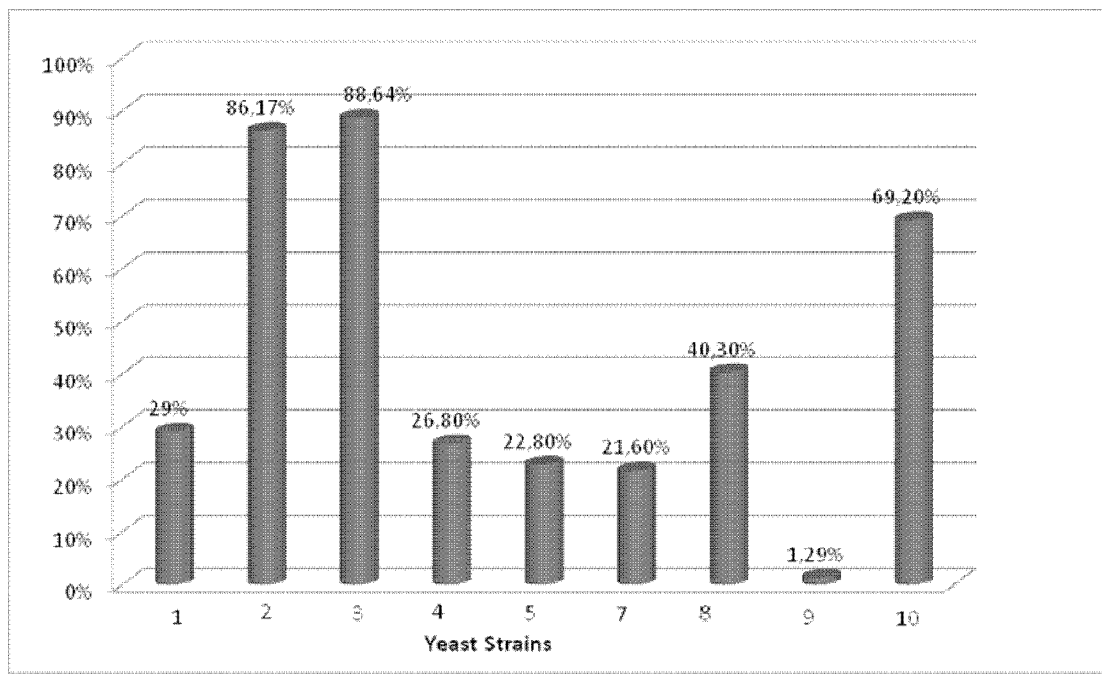

FIG. 21: Comparative fatty acid yield of yeast strains of invention when grown on 5% crude glycerol as carbon source.

Figure 22:
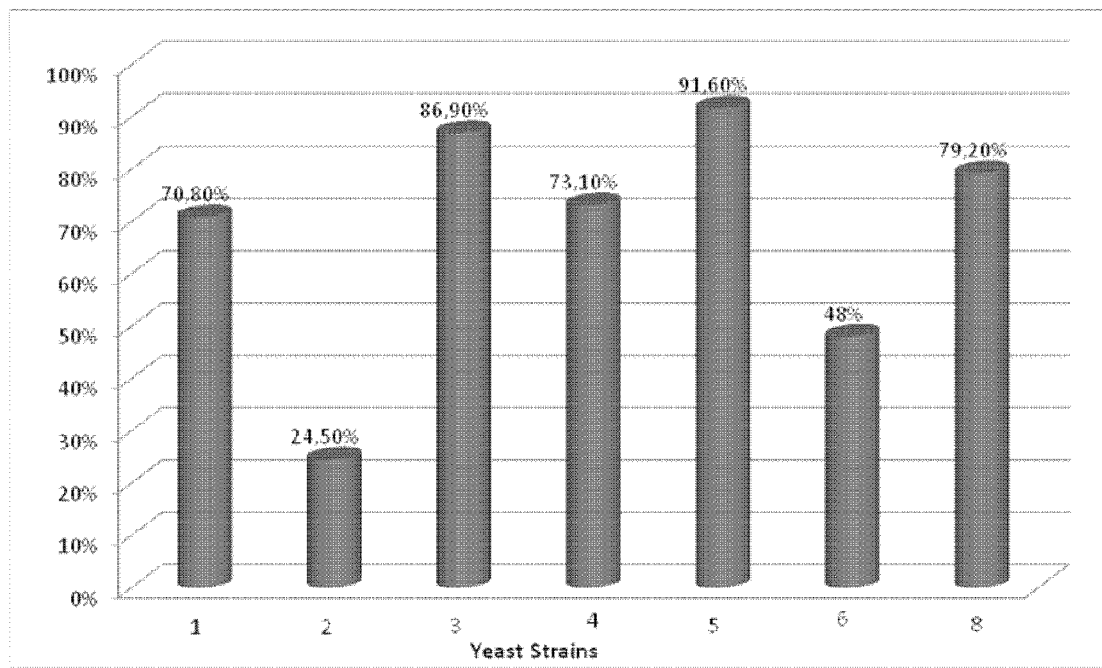
Figure 23:
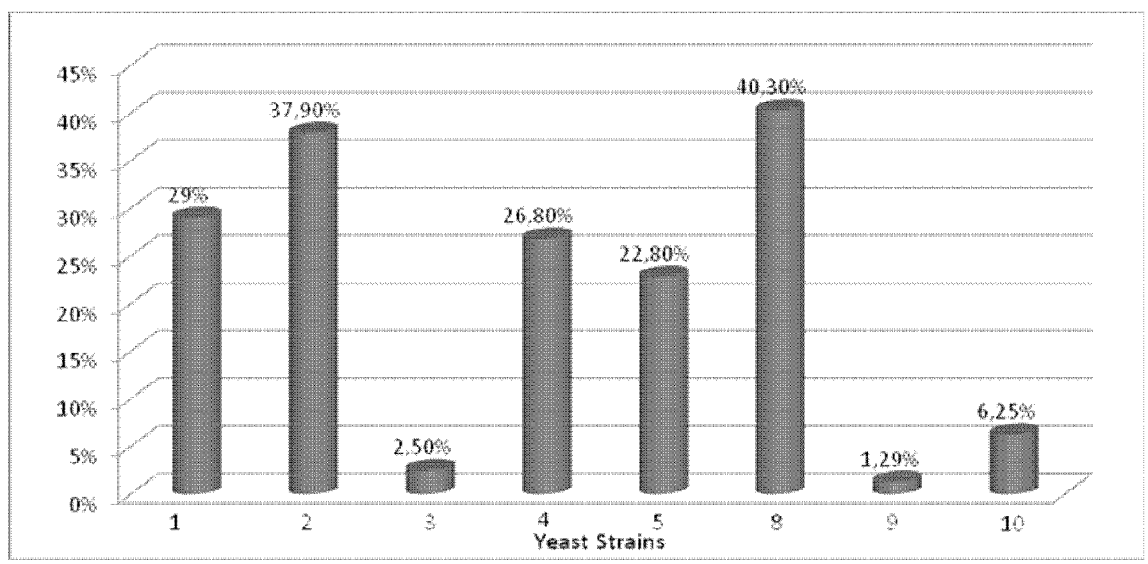

FIG. 22: Comparative fatty acid yield of yeast strains of invention when grown on 15% xylose as carbon source FIG. 23: Comparative fatty acid yield of yeast strains of invention when grown on 10 ml/L hydrolysed wheat kignocellulose as carbon source

Aim of the Invention

The present invention provides an alternative source of biodiesel, which relies on modified yeast strain(s), whose metabolic pathway for Lipid Biosynthesis is specifically engineered to overproduce and secrete esterified fatty acids when supplied with one or more substrates such as glucose, starch, glycerol and lignocellulose. While the fatty acids and their esters that are secreted by the yeast strain(s) commonly vary in chain-length, wherein a high proportion of the fatty-acids produced are long-chain fatty acids (C:16, C:18 and longer), it is desirable to produce fatty acids and their esters of slightly shorter chain-lengths, since these are considered to be qualitatively superior as a source of biodiesel.

Definitions

ACC1—gene encoding acetyl CoA carboxylase.

FAA2—gene encoding long chain fatty acyl-CoA synthetase (Faa2p; EC No: 6.2.1.3) that accepts a wider range of acyl chain lengths than Faa1p, preferring C9:0-C13:0; and is involved in the activation of endogenous pools of fatty acids;

MCFA—medium chain fatty acid pflA—gene encoding pyruvate formate lyase A (PflA)

pflB—gene encoding pyruvate formate lyase B (PflB)

SCFA—short chain fatty acid

VLCFA—very long chain fatty acid

1.0 Selection of the Microorganism of the Invention

The microorganism of the invention is a yeast or fungal species, since yeast and fungi can accumulate oils under some cultivation conditions, and some yeast and fungi species secrete fatty acids into the medium when grown on certain carbon sources. Accordingly, a yeast or fungal species of the invention is one that is able to secrete fatty acids extracellularly in the medium, and is capable of producing a large cell biomass combined with and a high extracellular lipid yield. A preferred yeast or fungal species according to the invention is a yeast or fugal species capable of secreting fatty acids and esters thereof, said yeast or fungal species belonging to the genus *Aspergillus* (e.g. *A. nidulans*), *Candida* (e.g. *C. tropicalis*; *C. magnolia*); *Cryptococcus* (e.g. *C. albidus*), *Debaryomyces* (e.g. *D. hansenii*), *Fusarium* (e.g. *F. oxysporum*), *Lindnera* (e.g. *L. jadinii*), *Lipomyces* (e.g. *L. lipofera* or *L. starkeyi*), *Monascus* (e.g. *M. purpureus*), *Mucor* (e.g.; *M. circinelloides, M. hiemalis; M. miehei; M. racemosus*), *Pachysolen* (e.g. *P. tannophilus*), *Pichia* (e.g. *P. pastoris; P. stipitis; P. angusta*); *Rhizopus* (e.g. *R. oryzae*), *Rhodosporidium* (e.g. *R. toruloides*); *Rhodotorula* (e.g. *R. glutinis*), *Saccharomyces* (e.g. *S. cerevisiae*); *Schizosacchromyces* (e.g. *S. pombe*); *Trichosporon* (e.g. *T. pullulan*), *Yarrowia* (e.g. *Y lipolytica*), *Zygosacchromyces* (e.g. *Z. rouxii*), or a strain of any one thereof. Preferably the micro-organism is a *Saccharomyces*, in particular *S. cerevisiae*.

In one embodiment of the invention, the microorganism belongs to the yeast genus *Candida*, in particular the species *Candida tropicalis*, said yeast being characterised by the secretion of palmitic acid.

2.0 Genetically Modified Yeast or Fungal Species of the Invention, Adapted to Synthesize and Secrete MCFAs A genetically modified yeast or fungal species/strain of the invention is preferably derived from a microorganism selected from the group set out above under section I. One or more gene controlling the metabolic pathways in the selected yeast or fungal species/strain is genetically modified to enable the selected species/strain to produce and secrete esters of fatty acids from various cheap carbon sources such as starch, glycerol and lignocellulose.

2.1.0 A Genetically Modified Yeast or Fungal Strain with Reduced Fatty Acid Catabolism

2.1.1 Deletion of Endogenous Fatty acyl-CoA Synthetase Gene, FAA2

In one embodiment, a yeast or fungal species/strain of the invention carries a deletion in the FAA2 gene (FAA2Δ strain) encoding the Faa2p, which catalyses the activation of medium-chain fatty acids, being the first committed step in beta-oxidation of these fatty acids. Deletion of FAA2 gene, in the yeast or fungal species, reduces the metabolic flux through fatty acid catabolism. In addition a FAA2Δ yeast or fungal species of the invention is characterised, not only by the synthesis of a surprisingly higher proportion of MCFAs than wild type yeast, but as further being capable of extracellular secretion of the MCFAs synthesized within the cell. Where the yeast strain is *Saccharomyces cerevisiae*, the deleted FAA2 gene is Gene ID: 856734 (SEQ ID No: 1) and encodes FAA2 (EC 6.2.1.3) having protein ID: P39518 (SEQ ID No: 2).

2.1.2 Silencing Endogenous Fatty Acyl CoA Synthetase Gene Expression

In a further embodiment, expression of the one or more endogenous fatty acyl-CoA synthetase (FAA) genes in the yeast or fungal species of the invention is silenced or knocked-down by means of gene deletion or by means of promoter engineering. For example, replacement of the native FAA gene promoters with promoters driving lower expression levels is used to drastically reduce the expression levels of gene FAA genes and their encoded enzymes located in peroxisomes and mitochondria.

Thus the promoters of each of the *S. cerevisiae*, FAA1, FAA3, FAA4 may be substituted with promoters driving lower expression levels. A corresponding strategy may be applied to silence or knock-down the expression of FAA genes in other yeast species. In one example the FAA gene to be silenced by gene deletion or knocked out by means of promoter engineering is one or more of the Faa1 gene (GeneID: 854495 (SEQ ID No: 3); encoding Protein ID—P30624: (SEQ ID No: 4)); the Faa3 gene (GeneID: 854808 (SEQ ID No: 5) encoding Protein ID—P39002 (SEQ ID No: 6)), and the Faa4 (GeneID: 855288 (SEQ ID No: 7) encoding Protein ID—P47912 (SEQ ID No: 8)) in *Saccharomyces cerevisiae*; the FAA gene (GeneID: 2541350 (SEQ ID No: 9) encoding Protein ID—Q9P7D7 (SEQ ID No: 10)) in *Schizosaccharomyces Pombe*; the FAA gene (GeneID: 3257561 (SEQ ID No: 11) encoding Protein ID—Q5KH65 (SEQ ID No: 12)) in *Cryptococcus neoformans*; the FAA gene (GeneID: 8300178 (SEQ ID No: 13) encoding Protein ID—C5MID6 (SEQ ID No: 14)) in *Candida tropicalis*; the FAA gene (GeneID: 2876383 (SEQ ID No: 15) encoding Protein ID—Q5BFS3 (SEQ ID No: 16)) in *Aspergillus nidulans*; and the FAA gene (GeneID: 2911089 (SEQ ID No: 17) encoding Protein ID—Q6C8Q3 (SEQ ID No: 18)) in *Yarrowia lipolytica*.

2.1.3 Inhibition of Fatty Acyl-CoA Synthetase Activity

In a further embodiment, the enzymatic activity of the endogenous fatty acyl CoA synthetase (FAA), in the yeast or fungal species of the invention, can be inhibited by means of inhibitors, for example with triacsin C (Pubchem. ID—CID: 9576787) or adenosine 5'-hexadecylphosphate. Triacsin-C can be added to the growth medium to inhibit FAA activity and thereby increase the levels of secreted fatty acids in the medium. This approach is useful in those cases where the FAA gene in the respective yeast or fungal species cannot be genetically modified.

2.1.4. Disruption and Inhibition of FATp1

In a further embodiment, the gene encoding the fatty acid transporter, FATp1 in the yeast or fungal species of the invention, is disrupted or inhibited. Lipid metabolism is compartmentalized in *Saccharomyces cerevisiae*, whereby the biosynthetic enzymes are located in the cytosol of the cell, whereas the catabolic enzymes are located in peroxisomes and mitochondria. In order for fatty acids to be oxidized, they must be transported into these respective cellular organelles by the means of transporter protein like "Fatty acid transporter" (FAT1), located on peroxisomal membrane. Fat1 is a medium chain fatty-acid-CoA activase itself. Thus, inhibition and/or disruption of this enzyme prevents the entry of fatty acids into peroxisomes, thereby reducing metabolic flux through the lipid catabolic pathway. In one example the FATp1 gene to be disrupted or inhibited FAA gene is the fatty acid transporter gene (GeneID: 852329 (SEQ ID No: 19) encoding Protein ID—P38225 (SEQ ID No: 20)) in *Saccharomyces cerevisiae*; fatty acid transporter gene (GeneID: 2911572 (SEQ ID No: 21) encoding Protein ID—Q6C5Q8 (SEQ ID No: 22)) in *Yarrowia* Lipolytica; fatty acid transporter gene (GeneID: 8197297 (SEQ ID No: 23) encoding Protein ID—C4QXD6 (SEQ ID No: 24)) in *Pichia pastoris*; and fatty acid transporter gene (GeneID: 8302036 (SEQ ID No: 25) encoding Protein ID—C5MBJ9 (SEQ ID No: 26)) in *Candida tropicalis*.

2.2.0 A Genetically Modified Yeast or Fungal Species/Strain with Increased Fatty Acid Anabolism

2.2.1 A Genetically Modified Yeast or Fungal Strain with Increased Production of Cytosolic Acetyl CoA A yeast or fungal strain of the invention is genetically modified by the transformation with and expression of a gene encoding Pyruvate-Formate lyase (pfl), which is an enzyme which converts pyruvic acid to acetyl-CoA and formic acid in the cytosol. PFL function in yeast requires expression of both the structural gene encoding the PFL homodimer (pflB) and its activating enzyme (pflA), and single electron donor as co-factor. Inactive PFL is converted into its active form under anaerobiosis by the stabilization of a glycyl radical in its active site, a process which is mediated by PflA. *S. cerevisiae* contains a cytosolic, single-electron donor capable of activating PFL. In one example the Pfl A and PflA gene from *E. coli* are transformed into the yeast or fungal strain. Since the availability of acetyl-CoA may function as one of the important constraints in the biosynthesis process of not only fatty alcohols but lipids in general, this genetic modification serves to boost the production of fatty acids by the fermenting organism.

Yeasts and fungi are eukaryotic organisms, in which many cellular processes are compartmentalization, such that the bulk of lipid-biosynthesis is located in cytosol, while catabolism is located in mitochondria and peroxisomes. Glycolysis, which leads to production of pyruvate, is localised in the cytosol of yeast and fungi, while the conversion of pyruvate to acetyl CoA takes place in mitochondria catalysed by pyruvate dehydrogenase complex. Thus, the concentration of acetyl-CoA is relatively lower in cytosol than in mitochondria. Pyruvate-Formate lyase is a "Bypass" for mitochondrial oxidation of pyruvic acid, converting pyruvate (formed by Glycolysis in cytosol) into formate and acetyl CoA. Since this enzyme is localised in the cytosol, it can be used to increase the concentration of acetyl CoA in the cytosol and more acetyl CoA is available for conversion into Malonyl CoA by ACC1 as described below under point 2.2.4.

The aim of the genetic modifications set out above under points 2.1.1; 2.1.2; 2.1.3; and 2.2.1, and below under point 2.2.4, is to maximise the number of carbon moles ingested by the fermenting organism that are forced to enter the lipid biosynthesis pathway.

2.2.2 A Genetically Modified Yeast or Fungal Species/Strain with Improved Redox Balance by Deletion of Formate Dehydrogenase (FDH) Gene The yeast or fungal strain of the invention that has been genetically modified to express pyruvate-Formate lyase (PFl A&B) (see point 2.2.1 above), will produce formate or formic acid in the cytosol. The yeast and fungal genome comprises a gene encoding formate dehydrogenase, which degrades formate to carbon dioxide and water, with production of an NADH molecule.

However, while growing on glycerol, there already is one NADH which is produced in pre-glycolytic oxidation of glycerol-Phosphate to Phosphoglyceraldehyde. The fatty acid biosynthesis reaction consumes two NADPH, while growth on glycerol produces two NADH. Coupled with activity of Pyruvate Formate Lyase and Formate Dehydrogenase, there will be four NADH produced per molecule of glycerol. To avoid this redox imbalance, the FDH gene is deleted, thus maintaining the redox balance of the metabolic system. In one example the FDH gene to be deleted is the FDH gene (GeneID: 854570 (SEQ ID No: 44) encoding Protein ID—Q08911 (SEQ ID No: 45)) in *Saccharomyces cerevisiae*; the FDH gene (GeneID: 8300341 (SEQ ID No: 46) encoding Protein ID—C5M8W6 (SEQ ID No: 47)) in *Candida tropicalis*, and the FDH gene (GeneID: 2907923 (SEQ ID No: 48) encoding Protein ID—Q6BZU8 (SEQ ID No: 49)) in *Yarrowia lipolytica*.

2.2.3 A Genetically Modified Yeast or Fungal Species/Strain with Improved Hydrogen Production Coupled to Redox Balance The yeast or fungal strain of the invention that has been genetically modified to express pyruvate-Formate lyase (PFI A&B) (see point 2.2.1 above), and from which the FDH gene has been deleted (see point 2.2.2 above), will produce formate or formic acid in the cytosol. Although the redox imbalance due to FDH activity is avoided by deletion of the FDH gene (see point 2.2.2), there remains the problem of an extra NADH, produced by PFI Activity. Furthermore, in higher concentrations, formic acid is toxic to the fermenting yeast cell. Thus, heterogenous expression of a bacterial formate-hydrogen lyase gene in the genetically modified yeast or fungal strain described under of 2.2.1 and 2.2.2 above (for example by transformation with the formate-hydrogen lyase A gene from *E. coli* (GeneID: 8486957 (SEQ ID No: 50) encoding Protein ID—C8UET5 (SEQ ID No: 51)) will secure coupled hydrogen production and redox equilibrium in the cell. Formate-Hydrogen lyase degrades formate molecule into hydrogen gas and carbon dioxide under anaerobic conditions. In the process of doing that, the enzyme utilizes one NADH as reducing equivalent. Thus, by this enzyme both the problems of Redox-imbalance and formate toxicity are solved. Furthermore, since the activity of this enzyme is optimum under anaerobic conditions, just like cytosolic pfl and ACC1, the activity of this enzyme will be optimal under the dual-phase fermentation method for the production and secretion of fatty acids according to the present invention.

2.2.4 A Genetically Modified Yeast Strain with Increased Production of Malonyl CoA Acetyl-CoA functions as a metabolic "junction", interconnecting several metabolic pathways, both anabolic and catabolic. Acetyl CoA Carboxylase (ACC) catalyses the reaction in which the Acetyl CoA is carboxylated to form a 3-carbon compound "Malonyl CoA", which is then committed to enter the metabolic pathway of lipid biosynthesis. Thus, a rise in the cytosolic concentration of Malonyl CoA in fermenting yeast will result in a higher flux through lipid-biosynthesis and higher production of fatty acids. The concentration of malonyl CoA in the modified yeast strain may be increased by over-expressing the ACC1 gene encoding an acetyl CoA Carboxylase which converts acetyl CoA into Malonyl CoA. In one example enhanced expression/synthesis of acetyl CoA Carboxylase can be obtained by manipulating the expression levels of the native ACC encoding gene in its host cell, for example by substituting the native ACC gene promoter with an alternative promoter that directs higher expression levels of the cognate ACC gene. Over-expression of the ACC1 gene in yeast can, for example, by achieved by replacing the endogenous promoter of the native ACC1 gene with the TEF1 promoter from *Saccharomyces cerevisiae* [SEQ ID NO: 113]. Suitable AAC1 genes to over-express include the ACC1 gene (GeneID: 855750 (SEQ ID No: 27) encoding Protein ID—Q00955 (SEQ ID No: 28)) in *Saccharomyces cerevisiae*; the ACC gene (GeneID: 2543344 (SEQ ID No: 29) encoding Protein ID—P78820 (SEQ ID No: 30)) in *Schizosaccharomyces pombe*; the ACC gene (GeneID: 8196923 (SEQ ID No: 31) encoding Protein ID—C4QXW1 (SEQ ID No: 32)) in *Pichia pastoris*; the ACC gene (GeneID: 8301221 (SEQ ID No: 33) encoding Protein ID—C5M4L7 (SEQ ID No: 34)) in *Candida tropicalis*; the ACC gene (GeneID: 2909424 (SEQ ID No: 35) encoding Protein ID—Q6CC91 (SEQ ID No: 36)) in *Yarrowia lipolytica*; and the ACC gene (GeneID: 2871016 (SEQ ID No: 37) encoding Protein ID—C8V2U7 (SEQ ID No: 38)) in *Aspergillus nidulans*.

2.3.0 A Genetically Modified Yeast or Fungal Species/Strain with Increased Production of Short Chain Fatty Acids, e.g. Lauric Acid The fatty acids secreted by the yeast or fungal species/strain of the invention is preferably shorter than 16 carbons in length, preferably 14 or 12 carbons in length. Fatty acid chain length is determined by the cytosolic enzyme, thioesterase (Acyl CoA-ACP Thioesterase), which cleaves the bond between growing fatty acid chain on the Fatty acid Synthase Complex (FAS) and releasing the fatty acid in the cytosol. Typically in yeast, the native Acyl CoA-ACP thioesterase cleaves the thioester bond between Fatty acyl-CoA and Acyl-Carrier Protein (ACP) when the fatty acid chain reaches 16 Carbons in length. However, certain other oil-plants such as Palm and Cinnamon have a native thioesterase that can cleave the thioester bond of a growing fatty acid chain when it reaches 12 carbons in length. Transformation of a yeast or fungal species/strain of the invention with a gene encoding Acyl CoA-ACP thioesterase from *Cuphea wrightii, Umbrella californica, Cinnamomum camphorum*, Soyabean, will increase the proportion of medium-chain fatty acids, thereby increasing the quality of the fuel-mixture derivable therefrom. In one example the yeast or fungal strain of the invention is genetically modified by transformation with a Acyl CoA-ACP thioesterase gene derived from any on of the following: Soyabean (*Glycine max*) GeneID: 100170693; *Chlamydomonas reinhardtii* (GeneID: 5722109 (SEQ ID No: 52) encoding Protein ID—A8HY17 (SEQ ID No: 53)); *Arabidopsis thaliana* (GeneID: 837372 encoding Protein ID—Q9SJE2 (SEQ ID No: 54)); *Ricinus communis* (GeneID: 8269197 (SEQ ID No: 55) encoding Protein ID—B9RAC3 (SEQ ID No: 56)); *Triticum aestivum* (GeneID: 543005); CtFatA from *Brassica napus* (Genbank accession number: X73849 (SEQ ID No: 57) encoding Protein ID—Q43745 (SEQ ID No: 58)); CtFatA from *C. tinctorius* (Genbank accession number: M96569 (SEQ ID No: 59) encoding Protein ID—Q42715 (SEQ ID No: 60)); GmFatA1 from *G. mangostana* (Genbank accession number: U92876 (SEQ ID No: 61) encoding Protein ID—O04792 (SEQ ID No: 62)); CwFatB1 from *C. hookeriana* (Genbank accession number:

U17076 (SEQ ID No: 63) encoding Protein ID—Q39513 (SEQ ID No: 64)); CwFatB1 from *C. wrightii* (Genbank accession number: U56103 (SEQ ID No: 65) encoding Protein ID—Q39662 (SEQ ID No: 66)); GmFatB1 from *G. Mangostana* (Genbank Accession number: U92878 (SEQ ID No: 67) encoding Protein ID—O04794 (SEQ ID No: 68)).

The expression of the thioesterase in the transformed yeast or fungal strain of the invention further enhances the esterification of the released fatty acids to ethyl esters.

2.4.0 A Genetically Modified Yeast or Fungal Species/Strain with Increased Secretion of Fatty Acid Esters Yeasts, such as *Saccharomyces cerevisiae* have the native capacity to secrete esterified fatty acids, such esters being preferred because they are chemically similar to "biodiesel". The enzyme Acyl-coenzymeA:ethanol O-acyltransferase converts fatty acids into ethyl esters of fatty acids, and thus overexpression of Acyl-coenzymeA:ethanol O-acyltransferase will enhance the secretion of fatty acid esters. Expression levels of the native Acyl-coenzymeA:ethanol O-acyltransferase gene (e.g. *Saccharomyces cerevisiae* (GeneID: 856010 (SEQ ID No: 71) encoding Protein ID—Q02891 (SEQ ID No: 72)); *Pichia Pastoris* (GeneID: 8196549 (SEQ ID No: 69) encoding Protein ID—C4QX24 (SEQ ID No: 70)) in a yeast strain of the invention can be achieved by replacing the native promoter of these genes with a stronger promoter.

2.5.0 A Genetically Modified Yeast or Fungal Species/Strain with an Increased Pool of Free Fatty Acids When the synthesis of a fatty acid is terminated and the fatty acid-chain is cleaved from the Fatty acid Synthase complex (FAS) by the activity of Acyl CoA-ACP thioesterase, the chain of fatty-acyl-CoA is released in cytosol. The enzyme Acyl-CoA Thioesterase that converts the fatty acyl-CoA chains into free fatty acids by cleaving off the CoA group is localized in the peroxisomes in yeast. The release of free fatty acids in the cytosol and recycling of Coenzyme A is enhanced in a genetically modified yeast or fungal species of the invention by the heterogenous expression of the cytosolic mammalian Cytosolic Acyl CoA thioesterase (CTE). A genetically modified yeast or fungal strain of the invention is transformed with a CTE gene derived from: *Mus muscilis* (GeneID: 26897 (SEQ ID No: 73) encoding Protein ID—O55137 (SEQ ID No: 74)); *Arabidopsis thaliana* (GeneID: 827955 (SEQ ID No: 75) encoding protein ID—Q5FYU1 (SEQ ID No: 76)); or *Rattus norvegicus* (GeneID: 170588 (SEQ ID No: 77) encoding Protein ID—Q6AZ44 (SEQ ID No: 78)).

2.6.0 A Genetically Modified Yeast or Fungal Species/Strain with a Decreased Ethanol Biosynthesis Carbon flux into ethanol synthesis is reduced in a genetically modified yeast or fungal strain of the invention, by means of the deletion of the native alcohol dehydrogenase genes, ADH1 and/or ADH5. Expression of the native alcohol Dehydrogenase gene in the genetically modified yeast or fungal strain of the invention is reduced by deleting one of the following genes: ADH1 from *Saccharomyces cerevisiae* (GeneID: 854068 (SEQ ID No: 79) encoding protein ID P00330 (SEQ ID No: 80)); ADH1 from *Schizosaccharomyces pombe* (GeneID: 2538902 (SEQ ID No: 81) encoding Protein ID P00332 (SEQ ID No: 82)); ADH1 from *Aspergillus nidulans* (GeneID: 2868277 (SEQ ID No: 83) encoding Protein ID C8VL73 (SEQ ID No: 84)); ADH5 from *Saccharomyces cerevisiae* (GeneID: 852442 (SEQ ID No: 85) encoding Protein ID—P38113 (SEQ ID No: 86)).

2.7.0 A Genetically Modified Yeast or Fungal Species/Strain Capable of Growth on Pentose and/or Hexose Sugars as Carbon Source The genetically modified yeast or fungal strain of the invention expresses a heterologous bacterial Glycerol Kinase and/or Xylose Isomerase genes such that the strain is capable of growth on lignocellulose derived substrates (e.g. pentose and/or hexose sugars) and/or glycerol as carbon source for production of biodiesel. These heterologously expressed enzymes serve to funnel the carbon flux towards fatty acid lipid biosynthetic pathway. A genetically modified yeast or fungal strain of the invention is transformed with a gene selected from one or more of: Xylose isomerase from *Clostridium phytofermentas* (GeneID: 5743318 (SEQ ID No: 87) encoding Protein ID—A9KN98 (SEQ ID No: 88)); Xylose Isomerase from *Yersinia pestis*—(GeneID: 1176874 (SEQ ID No: 89) encoding Protein ID—Q8Z9Z1 (SEQ ID No: 90)); and Glycerol Kinase from *Saccharomyces cerevisiae* (GeneID: 856353 (SEQ ID No: 91) encoding Protein ID—P32190 (SEQ ID No: 92)).

3.0 Method for Enhanced Production and Extracellular Secretion of Fatty Acids and their Esters by the Yeast Stains of the Invention In a first embodiment, the growth of the yeast strain of the invention and extracellular secretion of fatty acids and their esters by the yeast strain, is obtained by a Dual-Phase fermentation method. According to this method, a selected growth medium is first inoculated with cells of the yeast strain of the invention. The inoculated culture is then incubated for a total period to be selected from between at least 1 hour to up to 200 hours, for example at least 3, 5, 10, 15, 20, 25, 30, 35, 40, 50, 60, 70, 80, 100, 120, 140, 160, or 180 hours. Preferably the total incubation period was about 84 hours, this being the optimum for obtaining the greatest yield of secreted fatty acids, while longer incubation periods were accompanied by decrease in yield, probably due to auto-digestion of the secreted fatty acids by the fermenting organisms. In the first phase of the incubation period, the growth medium is initially aerated (defined as an oxygen saturated growth medium aerated/oxygenated to 100, 95, 90, 85, 80, 75, 70, 65, 60, 55, 50, 45, 40, 35, 30, 25, 20, 15, 10, 5, 1, 0.1%) for a period sufficient to allow aerobic growth of the yeast strain. Saturated oxygen conditions can be obtained by supplying a flow of oxygen at an uptake rate of 1.20 mmol/g/h and shaking the culture at a rate of about 100-120 rpm. The aerobic growth conditions are maintained for period of time to be selected from at least 1 hour to up to 20 hours, for example at least 2, 3, 4, 5, 6, 7, 8, 9, 10, 12, 14, 16, 18 or 20 hours. The aeration of the growth medium is reduced at the end of the selected aerobic growth period, by partial or complete cessation of the oxygen supply. As a consequence, the growth medium that was initially saturated with oxygen gradually becomes anaerobic as the oxygen levels decline, causing the cells of the yeast strain to enter a second anaerobic growth phase. By the end of aerobic growth period, the culture typically reaches an optical density of 4 to 5, providing a sufficient number of cells entering the anaerobic stage of respiration, where the cells start secreting and releasing fatty acids in the medium. The OD tends to vary with different yeast strains depending upon their specific growth rate.

As a further embodiment of the above described Dual-Phase fermentation method, the temperature at which the yeast strain of the invention is incubated is maintained at a constant temperature of between 15 and 45° C., for example 18, 20, 22, 24, 26, 28, 30, 32, 34, 36, 38, 40 or 45° C., or any temperature value lying in between the above values. Preferably the temperature is maintained at between 25 and 35° C.

As a further embodiment of the above described Dual-Phase fermentation method, the pH of the growth medium in which the yeast strain are cultured is maintained at a constant pH of between 2.5 and 4.5, for example 2.8, 3.0, 3.2, 3.4, 3.6, 3.8, 4.0, 4.2 or 4.5, or any pH value lying in between the above values. Preferably the pH is maintained at between 3.0 and 4.5. The pH can be maintained by HCl/NaOH regulation, where the pH of the culture is periodically checked and the pH then adjusted to 3.5 by adding appropriate amounts of NaOH or HCl. When sodium citrate buffer was used to maintain pH, the yields of fatty acids decline, due to the inhibitory effect of citrate on fatty acid synthesis.

As a further embodiment of the above described Dual-Phase fermentation method, the growth medium in which the yeast strain are cultured is a synthetic medium designed to exert maximum osmotic stress, by providing a high sugar (e.g. 200 g/l dextrose) concentration, combined with a source of nitrogen (e.g. ammonium sulfate) and essential vitamins of the B complex group. In a preferred embodiment, the medium is based on Wickerham synthetic medium (1951, ref), which is modified to exert osmotic stress. Preferably the medium is supplemented with a carbon source such as glycerol, glucose, pentose sugars at a preferred concentration of: 1% to 5%, glycerol; 15% to 20% glucose concentration; and 15% to 20% pentose.

As a further embodiment of the above described Dual-Phase fermentation method, the fermentation is carried out in a bioreactor provided with a controllable means for supplying the culture with oxygen, to facilitate both aerobic and anaerobic growth phases. Further the bioreactor is one that is provided with a means for stirring the culture, and preferably allows for the continuous introduction of nutrients. Preferably, the bioreactor is provided with means for separating the extracellular medium from the yeast cells.

4.0.0 Production of Alkanes from Free Fatty Acids by Fatty Acid Decarboxylation Free fatty acids secreted by the genetically modified yeast or fungal species/strains of the invention may be converted to alkanes by a variety of chemical steps as set out below:

4.0.1 Barton Decarboxylation

Free fatty acids may be catalytically converted alkanes by decarboxylation by the means of Barton Decarboxylation (organic-chemistry.org/namedreactions/barton-decarboxylation.shtm) OR Hunsdiecker Reaction (organic-chemistry.org/namedreactions/hunsdiecker-reaction.shtm).

4.0.2 Kolbe Electrolysis

Free fatty acids may be converted to alkanes by electrolytic decarboxylation by means of Kolbe electrolysis. (organic-chemistry.org/namedreactions/kolbe-electrolysis.shtm).

4.0.3 Palladium/Platinum (PD/C) Catalyst

Free fatty acids may be converted to alkanes by treatment with a PD/C catalyst at 300° C. and pressure 12 bars for 4 hours.

4.0.4 Enzymatic Decarboxylation

Free fatty acids may be converted to alkanes by decarboxylation with immobilized enzymes, which may be prepared from extracts of cells comprising suitable enzymes such as the insects: *Apis mellifera, Musa domestica, Zootermopsis angusticollis, Triatoma infestans* which contain native long-chain fatty acid-decarboxylase for decarboxylation of fatty acids longer than 20 carbon in chain-length. Further suitable enzymes may be obtained from extracts of the algae: *Crocosphaera* spp, *Isochrysis, Prymnesium* spp, *Ectocarpus* spp, *Laminaria* spp, *Streblonema* spp. The genetically modified yeast cells of the invention, when grown on the modified growth medium of the invention are known to secrete fatty acids with chain-length longer than 20 carbon atoms. The presence of Long-Chain Fatty acids (LCFAs) decreases the quality of the biodiesel by increasing its density and increasing the freezing point of the fuel-mixture, increasing their tendency to freeze in colder weathers. To avoid this and to increase the calorific value of the fuel, the LCFAs are decarboxylated enzymatically by the means of LCFA decarboxylases present in the extracts of various insects like "honey bee" (*Apis mellifera*), Wood-termite (*Cootermopsis angusticollis*), Triatoma etc. The Fatty-acid mixture, secreted by the yeast of the invention is treated with enzymes present in the immobilized extracts of these insects along with NADPH solution is treated on in the medium. The proportion of LCFAs in the medium with chain-length of 20, 22, 24 carbon atoms will be decarboxylated to yield the corresponding alkanes with one carbon less than the parent chain-length. Thus, the resultant fuel mixture is of higher calorific value.

EXAMPLE 1

Optimal Growth Conditions, with Respect to Temperature, PH, Media Composition and Dextrose Concentration, for Fatty Acid Production by Yeast Growth conditions that maximise fatty acid production in yeast were tested, with a view to identifying conditions that modulate biomass increase and those that enhance fatty acid synthesis and accumulation and/or secretion.

Two strains of the yeast, *Saccharomyces cerevisiae* were tested in parallel:
1) National centre for industrial microorganisms (NCIM) strain 3090, (nci-india.org/ncim/cataloguedetails.jsp?mid=29&category=yeast&ncimno=3090)
2) Ordinary baker's yeast strain.

The strains were grown on Wickerham Synthetic Medium (Wickerham L J. 1951. Taxonomy of yeast. US Department of Agriculture, Technical Bulletin No. 1029.) whose composition is set out in Table 1, but modified as indicated with respect to carbon source.

TABLE 1

Wickerham Synthetic Medium (Wickerham et al 1951 supra)

| Component | Composition (grams/liter) |
|---|---|
| Yeast extract | 6.7 g |
| Carbon Source | |
| Dextrose | 200 g |
| Nitrogen Source | |
| Ammonium sulphate | 5 g |
| Vitamins* | |
| Biotin | 20 μg |
| Calcium pantothenate | 2 μg |
| Folic acid | 2 ug |
| Inositol | 10 mg |
| Niacin | 400 μg |
| Riboflavin | 200 μg |
| Pyridoxine hydrochloride | 400 μg |
| Thiamine hydrochloride | 400 μg |
| Compounds supplying trace elements | |
| Boric acid | 500 μg |
| Copper sulphate | 40 μg |
| Potassium iodide | 100 μg |
| Ferric chloride | 200 μg |
| Manganese sulphate | 400 μg |
| Sodium molybdate | 200 μg |
| Zinc sulphate | 400 μg |
| Salts | |
| Potassium phosphate monobasic | 850 mg |
| Potassium phosphate dibasic | 150 mg |
| Magnesium sulphate | 500 mg |
| Sodium chloride | 100 mg |
| Calcium chloride | 100 mg |

Fermentation Conditions:

i) Dual-Phase fermentation of growth medium inoculated with either of the two strains was carried out in 1-liter bioreactors for a period of 84 hours. The growth medium was initially saturated with oxygen for the first 10 hours after inoculation. The oxygen supply to the reactor was then stopped such that the yeast cells gradually entered an anaerobic growth phase, as anaerobic conditions build up in the bioreactor as the oxygen level declined. Un-inoculated fermentations were carried out in parallel as a control for comparison with inoculated cultures.

ii) The effect of growth temperature was analysed by adjusting the temperature of the growth medium to a temperature ranging from 15 to 45° C., as indicated in FIG. 1a. In all other tested fermentation conditions the growth medium in the bioreactor was maintained at a temperature of 30° C.

iii) The effect of glucose concentration was analysed by supplementing the fermentation medium with glucose as the carbon source in place of dextrose in a final concentration of between 5 and 20 g/liter, as indicated in FIG. 1b.

iv) The effect of pH was analysed by adjusting the pH of the fermentation medium by addition of HCl or NaOH, to obtain a pH of between 2.0 and 5.0, as indicated in FIG. 1c.

Analysis of Fatty Acid Production:

After 84 hr fermentation, the yeast cells from each fermentation were separated from the fermented broth by centrifugation. Fatty acids were extracted from the cells by the method described by Cocito, C and Delphini, C. 1994, in *Food Chemistry*, 50(3), 297-305. Fatty acids, in the growth medium or extracted from the cells, were saponified using aqueous or alcoholic KOH, and the saponified fatty acids were recovered by centrifugation, and subsequently acid-treated with concentrated HCl to produce free fatty acids. The fatty acids were then separated from the aqueous phase using solvent extraction with diethyl ether or chloroform. The extracted fatty acids were subjected to gas chromatographic analysis to identify the fatty acids composition and their chain-lengths.

Gas Chromatography (GC) Conditions:

Methyl Esters of the fatty acid samples were prepared and injected (volume: 1.0 ml) into the GC Instrument: [Chemito GC 8610; equipped a 10% FFAP 3 m column with an O.D: ⅛, Mesh-80/100; and a FID Detector: FID] using chloroform as solvent. The temperature Program: Initial tempature 1:100° C.; hold 1:2 min; rate 1:10° C.; temperature 2: 250° C.; gold 2:25 min; Injection/Detector temperature: 250° C./250° C.; carrier Flow: 30 ml/min; range: ×10; attenuation: ×1;

TABLE 2

Fatty acids content of the sample measured by GC, where the peaks in the chromatogram (FIG. 2), can be compared with the values in the table. The value corresponding to the peak signifies the presence of that particular chain length fatty acid (given in last column of the table)

| Peak No. | Retention Time | Area [mV · s] | Height [mv] | W05 [min] | Area [%] | Height [%] | Result (MCFA's) |
|---|---|---|---|---|---|---|---|
| 1 | 6.387 | 5.4011 | 0.359 | 0.253 | 0.124 | 0.153 | Caproic Acid (C6) |
| 3 | 9.393 | 40.9518 | 2.783 | 0.240 | 0.938 | 1.186 | Caprylic Acid (C8) |
| 5 | 12.207 | 162.2671 | 10.256 | 0.253 | 3.716 | 4.373 | Capric Acid (C10) |
| 7 | 14.773 | 559.4485 | 36.779 | 0.233 | 12.813 | 15.681 | Lauric Acid (C12) |
| 11 | 17.120 | 263.1979 | 17.757 | 0.240 | 6.028 | 7.571 | Myristic Acid (C14) |
| 14 | 19.773 | 607.1143 | 32.803 | 0.307 | 13.904 | 13.986 | Palmitic Acid (C16) |

Conclusions

The conditions that are most conducive for production and extra-cellular secretion of Medium Chain Fatty Acids (MCFA) by the two strains of *Saccharomyces cerevisiae* when grown in Wickerham Synthetic Medium are as follows:

TABLE 3

Optimal growth conditions for MCFA production by yeast

| Parameters | Value |
|---|---|
| Temperature | 25° C. |
| pH | 3.5 |
| Glucose Concentration | 18 g/liter |
| Fermentation conditions | Initially aerobic, later anaerobic |

MCFAs were secreted extra-cellularly into growth medium, where both the MCFAs and their ethyl esters are candidates for use as Biodiesel.

While not by theory, it is believed that fatty acid synthesis in micro-organisms (including yeast) adapts the membrane fatty acid profile (in particular its phospholipid content) in order to maintain its fluidity in response to changing growth temperature. Higher temperatures stimulate synthesis of longer chain FAs with a higher boiling point, while lower temperatures stimulate synthesis of lower chain length FAs with lower density and boiling point.

Increasing the sugar concentration in the fermentation medium appears to activate the lipid biosynthesis machinery, where it is believed that excess Acetyl CoA produced by glycolysis, is diverted to malonyl CoA production which in turn leads to FA biosynthesis. A high glucose concentration also exerts osmotic pressure on the plasma membrane of the yeast cells, to which the membrane adjust by becoming more resilient. This is achieved by increasing the content of MCFA's and unsaturated FA's [UFAs] in membrane. whereby the kinks in the unsaturated chain cause the molecules to interlock, thereby increasing their resilience.

The production and secretion of FAs is greatest around pH 3.5, and their secretion cause the pH to decrease due to their acidity. However, with time, pH starts increasing again, which is thought to be due esterification of the free fatty acids that are produced. Thus both MCFAs and their ethyl esters are seen to accumulate in the growth medium.

EXAMPLE 2

Deletion of FAA2 Gene from *Saccharomyces cerevisiae* Enhances the Production of Fatty Acids 2.0.0 Methods The FAA2 gene was deleted *Saccharomyces cerevisiae* strain CEN-PK2 (MATa/MATa; ura3-52/ura3-52; trp1-289/trp1-289; leu2-3,112/leu2-3,112; his3 D1/his3 D1; MAL2-8C/MAL2-8C; SUC2/SUC2) obtained from strain collection of CSM, and replaced with the 1.1 kbp URA3 marker gene (derived from *Kluyveromyces marxianus*) conferring the capacity to synthesize uracil. URA3 encodes orotidine 5-phosphate decarboxylase (ODCase), an enzyme involved in the synthesis of pyrimidine ribonucleotides. Primer set one was designed to delete FAA2 gene along with 150 base-pairs flanking the FAA2 gene upstream, and 60 base-pairs flanking the FAA2 downstream in the parent CEN-PK2 strain (henceforth called WT-strain). Primer set 3, which binds near the centre of the FAA2 gene sequence, was used to amplify a ~1300 by fragment of the FAA2 gene, in order to detect the FAA2 gene in genomic DNA from the WT-strain. The primers were designed using Primer-Design Tool available on www.yeastgenome.org.

TABLE 4

List of primers used for the purpose of gene deletion

| Primer set 1 (for FAA2 deletion) | Upstream flank-<br>*CAGCTATGACCATGATTACG*GGAGTCAAAACGAGGGAACTCAATATTAATTGCGGAGTTGAGCGAT<br>GATGGGTTGGAACTATATAAAGCATCGGAAACGCATGGCTAAGGGAAGTGGAAGAATGCAGGTTA<br>CAAAAAACGGATAAGAACAAACTTGTTTCGAAAT-FAA2<br>Downstream Flank-FAA2-<br>GTACTTATGACGATTTGGAACACATTCAAACTAGAAAAAACTTTGATGTAGGATATCCCT*TTTTTGAT<br>CGGGTAATAACTG* |
|---|---|
| Primer set 2 For URA3 amplification) | URA3 Upstream flank-fw: TGACCATGATTACGAATTAG;<br>Rv: CTTCAAACCGCTAACAATAC |
| Primer Set 3 (For FAA2 amplification) | FAA2 Fw: ATGGCCGCTCCAGATTATGC; FAA2 Rv: TGCAAAAATCAGAATGGGGG |

Primer set 1: upstream: SEQ ID NO: 93; downstream: SEQ ID NO: 94,
Primer set 2: URA3 upstream flank fw: SEQ ID NO: 95; Rv: SEQ ID NO: 96,
Primer set 3: FAA2 Fw: SEQ ID NO: 97; FAA2 Rv: SEQ ID NO: 98.

WT-strain genomic DNA was extracted and subjected to Fusion PCR where the URA 3 gene was inserted in place of the deleted FAA2 gene. The yeast cells were transformed with URA3 according to protocol described by Gietz (Gietz, Jean et al. 1992). The transformed colonies were grown on SD-URA minimal medium plates. Colony PCR was conducted using Primer set 2, which clearly demonstrated the presence of the inserted URA3 gene and the loss of FAA2 gene in the mutant colonies. Stable mutant colonies were propagated on minimal media plates.

The transformed yeast strains were grown in YPD medium for 2 days to an O.D of 2 and subsequently, the growth experiments were conducted in Modified Wickerham's synthetic media, as given in Table 5, for 6 days.

TABLE 5

Modified Wickerham Synthetic Medium

| Component | Composition (grams/liter) |
|---|---|
| Carbon Source | |
| Dextrose (or alternative carbon source*) | 180 g (or as defined) |
| Nitrogen Source | |
| Ammonium sulphate | 5 g |
| Vitamins | |
| Biotin | 20 µg |
| Folic acid | 2 µg |
| Inositol | 10 mg |
| Niacin | 400 µg |
| Riboflavin | 200 µg |

TABLE 5-continued

Modified Wickerham Synthetic Medium

| Component | Composition (grams/liter) |
|---|---|
| Pyridoxine hydrochloride | 400 µg |
| Thiamine hydrochloride | 400 µg |
| Compounds supplying trace elements | |
| Boric acid | 500 µg |
| Copper sulphate | 40 µg |
| Potassium iodide | 100 µg |
| Ferric chloride | 200 µg |
| Manganese sulphate | 400 µg |
| Sodium molybdate | 200 µg |
| Zinc sulphate | 400 µg |
| Salts | |
| Potassium phosphate monobasic | 850 mg |
| Potassium phosphate dibasic | 150 mg |
| Magnesium sulphate | 500 mg |
| Sodium chloride | 100 mg |
| Calcium chloride | 100 mg |

*alternative carbon sources: glycerol, xylose, digested cellulose and hemicelluloses, starch, mannitol and other sugar-alcohols, xylan.

The fermentation conditions were multiphase comprising an initial 48 hours of aerobic growth, followed by 4 days of anaerobic conditions to facilitate the release of fatty acids into the medium. The flasks were incubated in a water-bath at 30° C. and shaken at a speed of 80 rpm for efficient mixing. After 6 days fermentation, the OD of the culture was measured and the cells were then removed from the liquid phase by centrifugation at 5000 rpm for 6 minutes. The intra-cellular and extra-cellular fatty acids in the cells and the supernatant were extracted and quantified, according to Cocito and Delfini, 1994 supra. The only deviation from the protocol was that the extracellular fatty acids were extracted in the solvent diethyl ether instead of chloroform.

GC conditions for analysis of fatty acids: employed a DBI capillary column, (30 m long and 0.25 mm i.d; film thickness 0.25 µm), with a temperature gradient of 40° C. to 200° C. at 6° C./min; 200° C. for 15 minutes; 200° C. to 260° C. at 6° C./min; 260° C. to 290° C. at 2° C./min; an injector temperature of 280° C.; detector temperature of 300° C.; a split rate of 1:20; using the carrier gas helium; and linear flow-rate of 1.5 ml/min; pressure 15.7 psig; and an injection volume of 1-2 µl.

Calculation of fatty acid yield: Area under the peak of particular component determines its percentage in the given mixture. The total percentage of fatty acids per 50 ml of extracted lipids is based on the sum of the percentages of largest components (those above 4% of yield). Subsequently, the proportion of those fatty acids per liter is calculated by means of simple cross-multiplication.

2.1.0 Production of a FAA2 Deletion Strain (FAA2Δura3) in *Saccharomyces cerevisiae*, WT-Strain The presence of FAA2 gene in the genome of WT strain was demonstrated by PCR employing primer set 3, where the amplified FAA2 gene fragment was separated and detected by gel electrophoresis (FIG. 5). Following transformation of the WT-strain, to delete the FAA2 gene, the transformed cells were grown on selective media plate (SD-URA). The growth of 16 colonies on SD-URA plates denoted successful transformation to yield Δura3 yeast strains. Genomic DNA, extracted from the deletion mutants, was subjected to PCR amplification using FAA2 primers and URA3 primers to confirm the Δura3 deletion event, FIG. 6*a,b*.

The FAA2 gene was not detected in transformed colonies that were amplified with primer set 3 confirming the deletion of the FAA2 gene from the genome of the mutant yeast (wells 3-9, 11-17 in FIG. 6*a,b*). The URA3 gene was clearly detected in several of the mutants colonies (wells 25, 26, 8, 30-33 in FIG. 6*a,b*) amplified with primer set 2 thereby demonstrating the Δura3 deletion event. The FAA2 deletion strain (FAA2Δura3) in *Saccharomyces cerevisiae* (AGPH-01) is deposited under the strain name CBS126804 with Centraalbureau voor Schimmelcultures, P.O Box 85167, 3508 AD Utrecht, NL on Apr. 26, 2010 in conformity with rule 9.1 and 11.4(g) of the Budapest Treaty.

2.2.0 Fatty Acid Synthesis and Secretion Profile of FAA2 Deletion Stain (FAA2Δura3) Versus *Saccharomyces cerevisiae* WT-Strain The FAA2Δ-stain and WT-strain were grown on Modified Wickerham's synthetic media with the specified carbon source, and fatty acids were extracted from the growth medium and cells respectively as set out under (2.0.0)

2.2.1. Extracellular Fatty Acid Profile of WT-Strain Grown on 20% Glucose

The Optical Density of the WT strain culture at the time of harvest was 11. The yield of fatty acids at the end of organic extraction of the culture medium was 5 ml per 50 ml of sampled culture medium. A crude sample of extracellularly secreted fatty acids, extracted from the culture medium, was separated by Gas-Chromatography and the components identified using Mass-Spectrometry (GC-MS). The GC-MS graph in FIG. 7 shows various peaks having retention times (RT) corresponding to components (mostly fatty acids) of the test-sample. All peaks corresponding to more than 4% of the secreted lipids are listed in Table 6.

TABLE 6

Major extracellular fatty acids secreted by WT strain grown on 20% glucose.

| Retention Time | Name of the component | Percentage of the component |
|---|---|---|
| 28.79 | Palmitic acid (C: 16) | 4% |
| 30.74 | Stearic acid (C: 18) | 11% |
| 32.04 | Tetratetracontane (C: 44) | 30% |
| 36.08 | Tetratetracontane (C: 44) | 22% |

The yield of pure fatty acids secreted by the WT-stain yeast was approximately 67 ml per liter of culture.

2.2.2. Intracellular Fatty Acid Profile of WT Strain Grown on 20% Glucose

The Optical Density of the WT strain culture at the time of harvest was 11. The yield of intracellular fatty acids extracted from cells from a 50 ml of sample was 0.5 ml. A sample of the extracted intracellular fatty acids was analysed by GC-MS. The GC-MS graph in FIG. 8 shows various peaks having retention times (RT) corresponding to components (mostly fatty acids) of the test-sample. All peaks corresponding to more than 4% of the secreted lipids are listed in Table 7.

TABLE 7

Major intracellular fatty acids in WT strain grown on 20% glucose

| Retention Time | Name of the component | Percentage of the component |
| --- | --- | --- |
| 28.84 | Palmitic acid (C: 16) | 5% |
| 30.81 | Stearic Acid (C: 18) | 10% |
| 32.48 | Oleic acid (C: 18,9) | 22% |

2.2.3. Extracellular Fatty Acid Profile of FAA2Δ ura3 Strain Grown on 20% Glucose The Optical Density of the culture at the time of harvest was 7. The yield of saponifiable fatty acids at the end of organic extraction of the culture medium was 10 ml per 50 ml of sampled culture medium. A sample of the extracted extracellular fatty acids was analysed by GC-MS The GC-MS graph in FIG. 9 shows various peaks having retention times (RT) corresponding to components (mostly fatty acids) of the test-sample. All peaks corresponding to more than 4% of the secreted lipids are listed in Table 8.

TABLE 8

Major extracellular fatty acids secreted by FAA2Δ strain grown on 20% glucose

| Retention time | Name of the component | Percentage of the component |
| --- | --- | --- |
| 27.34 | Pentadecanoic acid (C: 15) | 5% |
| 28.80 | Palmitic acid (C: 16) | 13% |
| 29.42 | Cycloeicosane (C: 20) | 9.5% |
| 30.76 | Stearic acid (C: 18) | 42% |
| 31.30 | ? | 7.6% |

The yield of pure fatty acids secreted by the FAA2Δ strain yeast was approximately 134 ml per liter of culture. Very Long Chain Fatty Acids (VLCFA) are not secreted by the FAA2Δ strain in contrast to the WT strain of S. cerevisiae.

2.2.4. Intracellular Fatty Acid Profile of FAA2Δ ura3 Strain Grown on 20% Glucose The Optical Density of the FAA2Δ strain culture at the time of harvest was 7. The yield of intracellular fatty acids extracted from cells from a 50 ml of sample was 0.4 ml. A sample of the extracted intracellular fatty acids was analysed by GC-MS The GC-MS graph in FIG. 10 shows various peaks having retention times (RT) corresponding to components (mostly fatty acids) of the test-sample. All peaks corresponding to more than 4% of the secreted lipids are listed in Table 9.

TABLE 9

Major intracellular fatty acids secreted by FAA2Δ strain grown on 20% glucose.

| Retention time | Name of the component | Percentage of the component |
| --- | --- | --- |
| 28.81 | Palmitic acid (C: 16) | 20% |
| 30.75 | Stearic acid (C: 18) | 23% |
| 32.36 | Oleic acid (C: 18,9) | 31% |

The relative amount of intracellular C18 fatty acids are elevated in the FAA2Δ strain grown on glucose when compared to the WT strain.

2.2.5. Extracellular Fatty Acid Profile of WT Strain Grown on 5% Glycerol

To assess alternative carbon sources in the growth medium, glucose was replaced by 5% glycerol, while keeping the remaining components of the growth medium constant. The Optical Density of the WT strain culture at the time of harvest was 7. The yield of fatty acids at the end of organic extraction of the culture medium was 4 ml per 50 ml of sampled culture medium. A sample of the extracted extracellular fatty acids was analysed by GC-MS The GC-MS graph in FIG. 11 shows various peaks having retention times (RT) corresponding to components (mostly fatty acids) of the test-sample. All peaks corresponding to more than 4% of the secreted lipids are listed in Table 10.

TABLE 10

Major extracellular fatty acids secreted by WT strain grown on 5% glycerol.

| Retention time | Name of the component | Percentage of composition |
| --- | --- | --- |
| 32.42 | Oleic acid (based on GC and RT) (C: 18,9) | 74% |

The yield of pure fatty acids secreted by the WT strain was approximately 60 ml per liter of culture.

2.2.6. Extracellular Fatty Acid Profile of FAA2Δ ura3 Strain Grown on 5% Glycerol The Optical Density of the WT strain culture at the time of harvest was 4. The yield of fatty acids at the end of organic extraction of the culture medium was 2.5 ml per 50 ml ml of sampled culture medium. A sample of the extracted extracellular fatty acids was analysed by GC-MS The GC-MS graph in FIG. 12 shows various peaks having retention times (RT) corresponding to components (mostly fatty acids) of the test-sample. All peaks corresponding to more than 4% of the secreted lipids are listed in Table 11.

TABLE 11

Major extracellular fatty acids secreted by FAA2Δ strain grown on 5% glycerol.

| Retention time | Name of the component | Percentage of the component |
| --- | --- | --- |
| 26.68 | Myristic acid (C: 14) | 4.1% |
| 28.83 | Palmitic acid (C: 16) | 18.0% |
| 30.78 | Stearic acid (C: 18) | 30.5% |
| 32.93 | Octadecamethyl cyclonosiloxane (C: 18) | 16.6% |

The yield of pure fatty acids (including siloxane) secreted by the FAA2Δ strain was approximately 32 ml per liter of culture (Table 12).

TABLE 12

Yields of secreted fatty acids by WT-strain and FAA2Δ strain

| Yeast strain | Fatty acid Yield | Carbon-source and Concentration |
| --- | --- | --- |
| WT-strain | 67 ml/liter | 20% glucose |
| WT-strain | 60 ml/liter | 5% glycerol |
| FAA2Δ strain | 134 ml/liter | 20% glucose |
| FAA2Δ strain | 32 ml/liter | 5% glycerol |

2.2.7 Summary of the Fatty Acid Synthesis and Secretion Profile of FAA2 Deletion Stain (FAA2Δura3) Versus *Saccharomyces cerevisiae* WT The FAA2Δ strain provides a 7%-8% increase in secreted pure fatty acids over the WT-strain, when grown on glucose as carbon source. When grown on glycerol, the yield of fatty acids decreases in both the FAA2Δ- and WT-stains, associated with a slower growth rate on this carbon source. The proportion of pure MCFAs secreted into the medium by the FAA2Δ strain was also increased by 16% over the WT-strain, if the VLCFA (tetratetracontane) produced by the WT-strain is excluded. The major MCFAs secreted by the FAA2Δ strain were palmitic acid (C:16:0) and stearic acid (C18:0) and oleic acid (C:18:1). The fatty acid-derivative of siloxane should be taken as the signal for the respective fatty acid in the original sample, due to a reaction between fatty acid esters in the sample with the stationary phase of the chromatography column.

In contrast to the WT strain, the mutant does not produce any trace of very long chain fatty acids (VLCFAs). VLCFAs are solid fats and essentially unsuitable as biodiesel. The fatty acid elongase system (ELO1, ELO2, ELO3) serves to elongate fatty acids of chain length 16 (MCFA) upward to 20-26 in *Saccharomyces cerevisiae*. The high proportion of VLCFAs produced by the WT-strain suggests that the activity of the elongase system is elevated in presence of FAA2 gene. Deletion of FAA2 gene, surprisingly, stalls this loss of carbon into VLCFAs via the fatty acid elongase system. Rather, the FAA2 deletion causes carbon flux to be channelled away from VLCFAs towards secretion of MCFAs, indicating a key role in determination of chain-length of fatty acid in yeast. The maximum yield of fatty acids, directly suitable for biodiesel synthesis obtained from the FAA2Δ strain reached as high as 18-20% from glucose. The yield of fatty acids per mole of glycerol was comparable, but slightly higher than for glucose. The growth conditions associated with anaerobic respiration lead to fatty acid secretion.

In conclusion, deletion of the FAA2 gene in yeast serves to inhibit MCFA catabolism and channels carbon flux into MCFAs, and enhances secretion of the fatty acids of this medium chain length (predominantly palmitic (C:16:0), stearic (C:18:0) and oleic (C:18:1) acids) providing a modified yeast stain of the invention adapted for biodiesel production.

EXAMPLE 3

Use of *Candida tropicalis* for the Production of Fatty Acids Suitable for Biodiesel

*Candida tropicalis* (DTU stain collection) was grown on Modified Wickerham's synthetic media with the specified carbon source, and fatty acids were extracted from the growth medium and cells respectively as set out under (2.0.0).

3.0.0

When *C. tropicalis* was grown on synthetic medium supplemented with glucose, and the secreted fatty acids extracted and analysed by GC-MS, a total of 21 peaks were detected (FIG. 13). The most prominent peak, corresponding to 35% of the total extracted fatty acids, had a retention time of 28.84 minutes, identified as palmitic acid. The yield of saponifiable fatty acids after organic extraction was 7.5 ml per 50 of medium. The yield of palmitic acid was 50 ml/liter of the medium.

3.0.1

When *C. tropicalis* was grown on synthetic medium (Table 5) supplemented with 5% glycerol, and the secreted fatty acids extracted and analysed by GC-MS, a total of 19 peaks were detected (FIG. 14). The most prominent peak, corresponding to 85.4% of the total extracted fatty acids, had a retention time (RT) of 28.92 minutes. Although the RT corresponded to the pesticide 2-Butoxyethyl 2-(2,2 dichlorovinyl)-3,3-dimethylcyclopropane carboxylate, the peak was attributed to palmitic acid, on the basis of their respective molecular mass. The yield of saponifiable fatty acids after organic extraction was 7 ml per 50 of medium. The yield of palmitic acid was 120 ml/liter of the medium.

3.0.2 Summary of the Fatty Acid Synthesis and Secretion Profile of *Candida tropicalis*

*C. tropicalis* grown on medium supplemented with either glucose or glycerol secretes the MCFA, palmitic acid, during the anaerobic fermentation phase. The yield of secreted palmitic acid is high, corresponding to 120 ml/liter of growth medium. Accordingly, *C. tropicalis* according to the present invention, is a yeast stain that is particularly suited for biodiesel production.

EXAMPLE 4

Overexpression of Acetyl CoA Carboxylase to Increase the Malonyl CoA Concentration

4.0.1

Over-expression of the ACC1 gene in yeast is achieved by replacing the endogenous promoter of the native ACC1 gene with the TEF1 promoter from *Saccharomyces cerevisiae* [SEQ ID NO: 113], in order to obtain ACC1 over-expression in a genetically modified yeast. A system for promoter replacement was based on a bipartite DNA molecule in which each of the two DNA fragments carries a target sequence, the sequence to be inserted, and a selectable marker gene, which is non-functional but homologous to some part of the same marker in the second fragment (FIG. 15). The first fragment contains the upstream sequence of ACC1, direct repeat and the upstream 2/3 *Kluyveromyces lactis* (Kl) URA3. The upstream which corresponded to the sequence in front of ACC1 promoter was amplified by primers ACC1 (SWA 3 and SWA4) using genomic DNA of wild type *S. cerevisiae* as a template. Direct repeat with the upstream 2/3 KI URA3 was amplified from pWJ1042 as template with primers SWA5 and 6 (Table 13). Two PCR products were then fused together by primers SWA3 and 6. To obtain the second fragment, three PCR products were generated. The downstream 2/3 KI URA3, which was homologous to 1/3 of KI URA3 in the first fragment, was amplified by using primer SWA7 and 8 (Table 13) from pWJ1042. The TEF1 promoter sequence and the downstream fragment that was homologous to the front part of ACC1 were amplified from yeast genomic DNA by using primers SWA9/10 and SWA11/12 (Table 13), respectively. The three PCR products were then fused by another PCR reaction using primers SWA7 and 12. The above-described two fragments were then be transformed into *S. cerevisiae* and integrated into the yeast chromosome by homologous recombination. The system was constructed so that the URA3 marker was recyclable. To delete the URA3 marker by recombination, transformants were plated on a medium containing 5-fluoroorotic acid (5-FOA). Since Ura3 metabolizes 5-FOA into a toxic compound, yeast that maintain URA3 are killed, whereas yeast lacking URA3 are resistant to 5-FOA and survive. The strain thus created was called a SC-ACC1 strain.

TABLE 13

| DNA Fragment | Primer name | Sequence |
|---|---|---|
| Upstream of ACC1 | SWA3 | CACAATTGTTATCGGTTCTAC |
|  | SWA4 | GCAGGGATGCGGCCGCTGACCTTGCTCTGAATCTGAATTCC |
| Direct repeat 1 and K1 URA3 | SWA5 | GTCAGCGGCCGCATCCCTGCTTCGGCTTCATGGCAA |
|  | SWA6 | GAGCAATGAACCCAATAACGAAATC |
| Direct repeat 2 and K1 URA3 | SWA7 | CTTGACGTTCGTTCGACTGATGAGC |
|  | SWA8 | CACGGCGCGCCTAGCAGCGGTAACGCCAGGGTTTTC |
| TEF1 promoter | SWA9 | CGCTGCTAGGCGCGCCGTGCACACACCATAGCTTCAAAATGTT |
|  | SWA10 | AATAAGCTTTCTTCGCTCATTTTGTAATTAAAACTTAGATTAGA |
| Downstream of ACC1 | SWA11 | ATGAGCGAAGAAAGCTTATTCGAGTCTTCTCCACAGAAGATGGA |
|  | SWA12 | TCTCGGAGGCGTGACCCCAG |

Primer SWA3-SEQ ID NO: 99; Primer SWA4-SEQ ID NO: 100; Primer SWA5-SEQ ID NO: 101; Primer SWA6-SEQ ID NO: 102; Primer SWA7-SEQ ID NO: 103; Primer SWA8-SEQ ID NO: 104; Primer SWA9-SEQ ID NO: 105; Primer SWA10-SEQ ID NO: 106; Primer SWA11-SEQ ID NO: 107; Primer SWA12-SEQ ID NO: 108.

4.0.2

The higher metabolic flux obtained by overexpression of ACC1 was coupled with inhibition of fatty acid catabolism in form of FAA2 deletion for net increase in production of fatty acids. The SC-ACC1 strain was used as template strand for introducing an FAA2 deletion by replacing it with URA3 gene as described in Example 2. The engineering of the double mutant strain, referred to as SC-FAA2-ACC1, is demonstrated by PCR analysis of gDNA extracted from the mutant strains (FIG. 16).

EXAMPLE 5

Expression of Pyruvate Formate Lyase Pfl (A&B) for Increased Pyruvate Flux

The concentration of acetyl CoA in the modified yeast strain is increased by the heterologous cytoplasmic expression of a bacterial gene encoding a Pyruvate formate lyase designated pfl A or pflB enzyme, which converts pyruvate (product of EMP pathway) into formate and acetyl CoA.

The Pyruvate Formate lyase gene (Pyruvate Formate Lyase A (Pfl A) (GeneID: 4491405 (SEQ ID No: 39) encoding Protein ID—A1A9E2 (SEQ ID No: 41)) or the Pyruvate formate lyase B (PflB) (GeneID: 4494334 (SEQ ID No: 42) encoding Protein ID—A1A9I0 (SEQ ID No: 43)) from *E. coli* K12) is first cloned on a vector (plasmid). The pflB, pflA, genes are amplified (FIG. 17) using their respective 5' and 3' forward and reverse primers (Table 14). The genes are cloned by the "biobrick" assembly strategy of prefix and suffix insertions using the restriction enzymes EcoRI, XbaI, SpeI, and PstI. The final constructs consist of pGal1-gene-Adh1_Terminator and are transferred into yeast Tet-off based shuttle vector PCM182 and PCM183 (FIG. 18). The assembly is then ready to be transferred to any yeast system for fatty-acid production.

TABLE 14

| Primers | Forward | Reverse |
|---|---|---|
| PflA | CCTTGAATTCGCGGCCGCATCTAGAATGTCAGTTATTGGTCGCAT | AAGGACTAGTTTAGAACATTACCTTATGACCGTACTGCTCAAGAATGCC |
| PflB | CCTTGAATTCGCGGCCGCATCTAGAATGTCCGAGCTTAATGAAAAG | AAGGACTAGTTTACATAGATTGAGTGAAGGTACGAGTAATAACGTCCTGCTG |

Primer PflA forward-SEQ ID NO: 109; reverse-SEQ ID NO: 110.
Primer PflB forward-SEQ ID NO: 111; reverse-SEQ ID NO: 112.

Four *Saccharomyces cerevisiae* strains (wild type and 3 engineered strains) were transformed with both the plasmids PCM182 (PflA) and PCM183 (PflB) and the transformed strains comprise both of the inserted PflA gene and PflB gene [designated PFL system] were selected by growing them on SC-TRP agar plates. The four mutant strains created were designated as follows:

*S. cerevisiae*—PFL system
*S. cerevisiae*—ΔFAA2+PFL system
*S. cerevisiae*—TEF1ΔACC1+PFL system
*S. cerevisiae*—ΔFAA2+TEF1ΔACC1+PFL system.

EXAMPLE 6

Production of Fatty Acids Suitable for Biodiesel from Different Carbon Sources Employing Yeast Strains of the Invention

6.0.1 Nomenclature of the Parent and Mutant Yeast Strains of the Invention

| Strain No. | *Saccharomyces cerevisiae* strain | Genotype |
|---|---|---|
| 1 | Parent strain—CENPK2 | WT |
| 2 | FAA2 deletion of WT | ΔFAA2 |
| 3 | TEF1/ACC1 promoter switch of WT | TEF1ΔACC1 |
| 4 | PFL system (PflA&B genes) inserted into WT | PFL |
| 5 | ΔFAA2/PFL double mutant of WT | ΔFAA2/ PFL |
| 6 | TEF1ΔACC1/PFL double mutant of WT | TEF1ΔACC1/PFL |
| 7 | ΔFAA2/TEF1ΔACC1 double mutant of WT | ΔFAA2/TEF1ΔACC1 |
| 8 | ΔFAA2/TEF1ΔACC1/PFL triple mutant of WT | ΔFAA2/TEF1ΔACC1/PFL |
| 9 | *Candida tropicalis*—Wild type | CT-WT |
| 10 | *Pachysolen tannophilus*—Wild type | PT-WT |

6.0.2 Profile of Fatty Acids Produced by Yeast Strains of the Invention Provided with 20% Glucose as Carbon Source Yeast strains were grown on the defined growth medium given in Table 5 (Modified Wickerham Synthetic Medium), where the selected sole carbon source was 20% Glucose. The growth of the yeast strains, under fermentation growth conditions, and the subsequent extraction and analysis of extracellular lipids produced (fatty acid production) were as defined in Example 2.0.0. The extracted fatty acids were concentrated to a volume 2 ml and was sent for GC-MS analysis. The profile of fatty acids in the 2 ml volume is set out in Table 15 and FIG. 19.

FIG. 19 shows that when the strains are grown on 20% glucose as substrate, the strains 4, 5 (comprising the PFL system which increases cytosolic levels of acetyl coA) enhances the yield of fatty acids being produced from glucose. Further the triple mutant (strain 8) shows that the pathway engineering of fatty acid biosynthesis process has a positive effect on the overall yield of fatty acids.

Table 15 reveals the effect of mutations on the profile of fatty acids produced. The bulk of fatty acids produced by WT yeast strain 1 are very long chain fatty acid (VLCFA) group, not suitable for biodiesel production. All of the mutations have dramatic and unexpected effect in reducing the chain-length of fatty acids while grown on glucose. Most of the fatty acids secreted by the mutant strains are medium-chain fatty acids which are commercially important in their role as biodiesel. The effect of FAA2 deletion alone on chain-length of fatty acids was unexpected.

Further, the double mutants in strains 4, 5, 6 and 7, produce fatty acids comprising an increasing proportion of shorter chain-length fatty acids.

The triple mutant (strain 8) shows lesser proportion of longer stearic acid and higher proportion of shorter chain-length fatty acids. The presence of these shorter fatty acids makes the quality of biodiesel better as the shorter fatty acids burn more completely and do not freeze in lower temperatures.

6.0.3 Profile of Fatty Acids Produced by Yeast Strains of the Invention Provided with 5% Pure Glycerol as Carbon Source Yeast strains were grown on the defined growth medium given in Table 5 (Modified Wickerham Synthetic Medium), where the selected sole carbon source was 5% pure glycerol. The growth of the yeast strains, under fermentation growth conditions, and the subsequent extraction and analysis of extracellular lipids produced (fatty acid production) were as defined in Example 2.0.0. The extracted fatty acids were concentrated to a volume 2 ml and was sent for GC-MS analysis. The profile of fatty acids in the 2 ml volume is set out in Table 16 and FIG. 20.

TABLE 15

Profile of fatty acids produced by yeast strains on 20% glucose

| Strain | C:6 | C:8 | C:11 | C:12 | C:14 | C:14,1 | C:15 | C:16 | C:17,1 | C:18 | C:20 | C >20 | Total |
|---|---|---|---|---|---|---|---|---|---|---|---|---|---|
| 1 | — | — | — | — | — | — | — | 14% | — | 11% | 0 | 52% | 77% |
| 2 | — | — | — | — | — | — | 5% | 13% | — | 42% | 9.5% | 0 | 69.5% |
| 4 | 1.4% | 1.9% | 2.9% | — | 2% | 14.8% | — | 34.1% | — | 30% | 2.1% | — | 89.2% |
| 5 | — | — | — | — | — | 14% | — | 49.5% | — | 30% | 2.5% | — | 96% |
| 6 | — | — | — | — | 2.1% | — | — | 52% | — | 26.5% | — | 2.8% | 83.4% |
| 7 | 2.4% | — | — | 2.9% | — | 14.7% | — | 41% | 13.3% | 14.6% | 3.2% | — | 92.1% |
| 8 | 3.6% | 5% | — | — | 4.1% | 21.1% | — | 30% | 16.2% | 12.6% | — | — | 92.6% |
| 9 | — | — | — | — | — | — | — | 35% | — | 22% | — | — | 57% |

TABLE 16

Profile of fatty acids produced by yeast strains on 5% pure glycerol

| Strain | C:6 | C:8 | C:14 | C:14,1 | C:16 | C:18 | C:20 | C >20 | C:18-1 | C:18-2,6 | Total |
|---|---|---|---|---|---|---|---|---|---|---|---|
| 1. | | | | | | | | 0 | 74% | | 74% |
| 2. | | 4% | | | 18% | 30.5% | | 0 | | | 52.5% |
| 3. | | | | | 1% | 1% | | | 7% | 2% | 11% |
| 5. | | | 2% | 20% | 43% | 32% | 2.6% | | | | 99.6% |
| 6. | | | | 23.4% | 45% | 31.4% | | | | | 99.8% |
| 7. | 5.8% | 1% | | | 20% | 11.5% | | | | | 38.3% |
| 8. | 10% | | | 5.1% | 7.8% | 7.2% | | | | | 30.2% |
| 9. | | | | | | 0 | | 2.25% | | | 2.25% |
| 10. | | | | | 4% | 0% | | | 15% | 0 | 19% |

FIG. 16 shows that when the strains are grown on 5% pure glycerol, where the single mutation strains (strain 2 and 3) produce lower levels of fatty acids than the WT strain 1. However, the double mutants comprising the PFL system show enhanced yields of fatty acids. The probable reason for this is that an extra NADH which is generated while incorporating glycerol into glycolytic pathway (glycerol>>glyceraldehydes-3-phosphate) remains unused, thereby creating a NAD+ imbalance which hampers the growth of single mutants. However, introduction of PFL system relieves the cellular system of this NADH imbalance and thus, we see better performance by double mutant strains with PFL system.

Table 16 reveals the effect of mutations on the profile of fatty acids produced. The double mutants (strains 5 and 6) comprising the PLF system show similar fatty acid profile consisting of MCFAs. The double mutant lacking the PFL system (strain 7) fails to mimic the high fatty acid yields of strain 5 and 6, confirming the key role of PFL system in enabling fermentation on glycerol to yield fatty acids. The triple mutant, again shows the surprising advantage of producing a higher proportion of lower chain-length fatty acids, although the total amount of fatty acids produced is less than WT or double mutant strains.

6.0.4 Profile of Fatty Acids Produced by Yeast Strains of the Invention Provided with 5% Crude Glycerol as Carbon Source Yeast strains were grown on the defined growth medium given in Table 5 (Modified Wickerham Synthetic Medium), where the selected sole carbon source was 5% crude glycerol. The growth of the yeast strains, under fermentation growth conditions, and the subsequent extraction and analysis of extracellular lipids produced (fatty acid production) were as defined in Example 2.0.0. The extracted fatty acids were concentrated to a volume 2 ml and was sent for GC-MS analysis. The profile of fatty acids in the 2 ml volume is set out in Table 17 and FIG. 21.

TABLE 17

Profile of fatty acids produced by yeast strains on 5% crude glycerol

| Strain | C:6 | C:8 | C:10 | C:12 | C:14 | C:14,1 | C:16 | C:17 | C:18 | C >20 | C:18-9 | C:18-9,12 | Total |
|---|---|---|---|---|---|---|---|---|---|---|---|---|---|
| 1. | | | | | | | 4.5 | | 7.7 | | 13.3 | 3.5 | 29% |
| 2. | | | | | | | 3.5% | | 1.57% | | 63.5% | 17.6% | 86.17% |
| 3. | | | | | | | 4% | | 1.8% | | 65% | 17.84% | 88.64% |
| 4. | 6.2% | 1.2% | | | | | 14% | | 5.4% | | | | 26.8% |
| 5. | 9.5% | | | | | 3.8% | 6.8% | | 2.7% | | | | 22.8% |
| 7. | 7% | | | | | 3.4% | 7.1% | | 4.1% | | | | 21.6% |
| 8. | 5.2% | | 4.9% | 1.2% | 12.9% | | 8.7% | 4.4% | 1.5% | 1.5% | | | 40.3% |
| 9. | | | | | | | 1.29 | 0 | | 0 | 0 | | 1.29% |
| 10. | | | | | | | 2.7% | | 13% | | 53.5% | | 69.2 |

Crude glycerol includes other components that may either promote or inhibit growth and fermentation of the yeast strains. The single mutant strains 2 and 3 as well as the triple mutant 8 show the capacity to grow on crude glycerol and to produce more MCFAs than the WT strain. Strain 10, is also surprisingly robust in its capacity to grow and ferment crude glycerol to fatty acids. The importance of deletion of the FAA2 gene, and the activation of ACC1 gene for fatty acid production by fermentation on glycerol is also confirmed in the performance of strains 2, 3 and 8.

6.0.5 Profile of Fatty Acids Produced by Yeast Strains of the Invention Provided with on 15% xylose as Carbon Source Yeast strains were grown on the defined growth medium given in Table 5 (Modified Wickerham Synthetic Medium), where the selected sole carbon source was on 15% xylose. The growth of the yeast strains, under fermentation growth conditions, and the subsequent extraction and analysis of extracellular lipids produced (fatty acid production) were as defined in Example 2.0.0. The extracted fatty acids were concentrated to a volume 2 ml and was sent for GC-MS analysis. The profile of fatty acids in the 2 ml volume is set out in Table 18 and FIG. 22.

TABLE 18

Profile of fatty acids produced by yeast strains on 15% Xylose

| Strain | C:6 | C:8 | C:10 | C:11 | C:12 | C:14 | C:14,1 | C:16 | C:16,1 | C:17,1 | C:18 | C:20 | Total |
|---|---|---|---|---|---|---|---|---|---|---|---|---|---|
| 1. |  | 2.1% |  |  | 2.2% | 2.3% | 9.9% | 16.7% |  | 29.9% | 5.4% | 2.3% | 70.8% |
| 2. | 1% | 9.7% | 2.2% |  |  |  |  | 2.2% |  |  |  | 9.4% | 24.5% |
| 3. |  |  |  | 2.70% |  | 2.4% | 17.9% | 43.3% | 3.1% |  | 15% | 2.5% | 86.9% |
| 4. | 2.3% | 1.1% | 2% |  |  |  | 10% | 29.7% |  |  | 26.3% | 1.7% | 73.1% |
| 5. |  |  |  |  |  |  | 17% | 50% |  | 19.6% |  | 5% | 91.6% |
| 6. |  |  |  |  |  |  |  | 28% |  | 10% | 10% |  | 48% |
| 8. |  |  |  |  |  | 2.14% | 8.9% | 39% |  | 12.7% | 14.2% | 2.3% | 79.2% |

Surprisingly, the strains 3, 4 5, and 8 were out-performed the WT in utilizing xylose, and producing fatty acids. Again the PFL system contributes to this enhanced capacity to produce fatty acids in the single, double and triple mutant strains.

6.0.6 Profile of Fatty Acids Produced by Yeast Strains of the Invention Provided with on Hydrolysed Wheat Lignocellulose as Carbon Source Yeast strains were grown on the defined growth medium given in Table 5 (Modified Wickerham Synthetic Medium), where the selected sole carbon source was on hydrolysed wheat lignocellulose (added as 10 ml/liter growth medium). The growth of the yeast strains, under fermentation growth conditions, and the subsequent extraction and analysis of extracellular lipids produced (fatty acid production) were as defined in Example 2.0.0. The extracted fatty acids were concentrated to a volume 2 ml and was sent for GC-MS analysis. The profile of fatty acids in the 2 ml volume is set out in Table 19 and FIG. 23.

TABLE 19

Profile of fatty acids produced by yeast strains on hydrolysed wheat lignocellulose

| Strain | C:6 | C:8 | C:10 | C:12 | C:14 | C:14,1 | C:16 | C:17 | C:18 | C>20 | C:18-9 | C:18-9,12 | Total |
|---|---|---|---|---|---|---|---|---|---|---|---|---|---|
| 1. |  |  |  |  |  |  | 4.5 |  | 7.7 |  | 13.3 | 3.5 | 29% |
| 2. |  |  |  |  |  |  | 1.5 |  | 2.4 |  | 27% | 7% | 37.9% |
| 3. |  |  |  |  |  |  | 0 |  | 0 |  | 2.5 | 0 | 2.5% |
| 4. | 6.2% | 1.2% |  |  |  |  | 14% |  | 5.4% |  |  |  | 26.8% |
| 5. | 9.5% |  |  |  |  | 3.8% | 6.8% |  | 2.7% |  |  |  | 22.8% |
| 8. | 5.2% |  | 4.9% | 1.2% | 12.9% |  | 8.7% | 4.4% | 1.5% | 1.5% |  |  | 40.3% |
| 9. |  |  |  |  |  |  | 1.29 |  | 0 |  | 0 | 0 | 1.29% |
| 10. |  |  |  |  |  |  |  |  | 5% |  | 1.5% |  | 6.25% |

The growth of the engineered yeast strains on digested lignocelluloses in the form of a wheat straw hydrolysate showed that the triple mutant strain (strain 8) produced more fatty acids than other engineered strains, while the single mutant FAA2 was also effective. Strain 8 however, has the additional advantage, compared to strain 2, in producing an even distribution of fatty acids of medium chain fatty acid range, important for biodiesel of the best quality. Furthermore, all of the fatty acids secreted by strain 8 are aliphatic, saturated fatty acids, while unsaturated fatty acids are distinctly present in the fatty acid profile of strain 2.

SEQUENCE LISTING (113 sequences)

SEQ ID NO: 1 - DNA, 2235 bp, Saccharomyces cerevisiae
  CDS (1)..(2235): GeneID:856734 encoding FAA2  [PID: P39518]
atggccgctccagattatgcacttaccgatttaattgaatcggatcctcgtttcgaaagtttgaagacaagattagccggttacaccaaaggctctgatgaatatattgaagagctatactctcaattaccactgaccagctatcccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaacgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagtgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatggaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttaaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcaccgatgggctacaaggattcgaaaaattgcataacatcaaagtcggacttgagcctttaactctcgaggatgatgttgtgacgccaacttttaaaataaagcgtgccaaagcatcaaaattcttcaaagatacattagaccaactatacgccgaaggttcactagtcaagacagaaaagctttag

SEQ ID NO: 2 - protein, 744 aa, Saccharomyces cerevisiae
MAAPDYALTDLIESDPRFESLKTRLAGYTKGSDEYIEELYSQLPLTSYPRYKTFLKKQAVAISNPDNEAGFSSIYRSSLSSENLVSCVDKNLRTAYDHFMFSARRWPQRDCLGSRPIDKATGTWEETFRFESYSTVSKRCHNIGSGILSLVNTKRKRPLEANDFVVAILSHNNPEWILTDLACQAYSLTNTALYETLGPNTSEYILNLTEAPILIFAKSNMYHVLKMVPDMKFVNTLVCMDELTHDELRMLNESLLPVKCNSLNEKITFFSLEQVEQVGCFNKIPAIPPTPDSLYTISFTSGTTGLPKGVEMSHRNIASGIAFAFSTFRIPPDKRNQQLYDMCFLPLAHIFERMVIAYDLAIGFGIGFLHKPDPTVLVEDLKILKPYAVALVPRILTRFEAGIKNALDKSTVQRNVANTILDSKSARFTARGGPDKSIMNFLVYHRVLIDKIRDSLGLSNNSFIITGSAPISKDTLLFLRSALDIGIRQGYGLTETFAGVCLSEPFEKDVGSCGAIGISAECRLKSVPEMGYHADKDLKGELQIRGPQVFERYFKNPNETSKAVDQDGWFSTGDVAFIDGKGRISVIDRVKNFFKLAHGEYIAPEKIENIYLSSCPYITQIFVFGDPLKTFLVGIVGVDVDAAQPILAAKHPEVKTWTKEVLVENLNRNKKLRKEFLNKINKCTDGLQGFEKLHNIKVGLEPLTLEDDVVTPTFKIKRAKASKFFKDTLDQLYAEGSLVKTEKL

SEQ ID NO: 3 - DNA, 2103 bp, Saccharomyces cerevisiae
  CDS (1)..(2103): Gene ID:854495 encoding FAA1 [Protein ID: P30624]
atggttgctcaatataccgttccagttgggaaagccgccaatgagcatgaaactgctccaagaagaaattatcaatgccgcgagaagccgctcgtcagaccgcctaacacaaagtgttccactgtttatgagtttgttctagagtgctttcagaagaacaaaaattcaaatgctatgggttggagggatgttaaggaaattcatgaagaatccaaatcggttatgaaaaaagttgatggcaaggagacttcagtggaaaagaaatggatgtattatgaactatcgcattatcattataattcatttgaccaattgaccgatatcatgcatgaaattggtcgtgggttggtgaaaataggattaaagcctaatgatgatgacaaattacatctttacgcagccacttctcacaagtggatgaagatgttcttaggagcgcagtctcaaggtattcctgtcgtcactgcctacgatactttgggagagaaagggctaattcattctttggtgcaaacggggtctaaggccatttttaccgataactctttattaccatccttgatcaaaccagtgcaagccgctcaagacgtaaaatacataattcatttcgattccatcagttctgaggacaggaggcaaagtggtaagatctatcaatctgctcatgatgccatcaacagaattaaagaagttagacctgatatcaagacctttagctttgacgacatcttgaagctaggtaaagaatcctgtaacgaaatcgatgttcatccacctggcaaggatgatctttgttgcatcatgtatacgtctggttctacaggtgagccaaagggtgttgtcttgaaacattcaaatgttgtcgcaggtgttggtggtgcaagtttgaatgttttgaagtttgtgggcaataccgaccgtgttatctgttttttgccactagctcatatttttgaattggttttcgaactattgtccttttattggggggcctgcattggttatgccaccgtaaaaactttaactagcagctctgtgagaaattgtcaaggtgatttgcaagaattcaagcccacaatcatggttggtgtcgccgctgtttgggaaacagtgagaaaagggatcttaaaccaaattgataatttgcccttcctcaccaagaaaatcttctggaccgcgtataataccaagttgaacatgcaacgtctccacatccctggtggcggcgccttaggaaacttggttttcaaaaaaatcagaactgccacaggtggccaattaagatatttgttaaacggtggttctccaatcagtcgggatgctcaggaattcatcacaaatttaatctgccctatgcttattggttacggtttaaccgagacatgcgctagtaccaccatcttggatcctgctaattttgaactcggcgtcgctggtgacctaacaggttgtgttaccgtcaaactagttgatgttgaagaattaggttattttgctaaaaacaaccaaggtgaagtttggatcacaggtgccaatgtcacgcctgaatattataagaatgaggaagaaacttctcaagctttaacaagcgatggttggttcaagaccggtgacatcggtgaatgggaagcaaatggccatttgaaaataattgacaggaagaaaaacttggtcaaaacaatgaacggtgaatatatcgcactcgagaaattagagtccgtttacagatctaacgaatatgttgctaacatttgtgtttatgccgaccaatctaagactaagccagttggtattattgtaccaaatcatgctccattaacgaagcttgctaaaaagttgggaattatggaacaaaaagacagttcaattaatatcgaaaattatttggaggatgcaaaattgattaaagctgtttattctgatcttttgaagacaggtaaagaccaaggtttggttggcattgaattactagcaggcatagtgttctttgacggcgaatggactccacaaaacggttttgttacgtccgctcagaaattgaaaagaaaagacattttgaatgctgtcaaagataaagttgacgccgtttatagttcgtcttaa

SEQ ID NO: 4 - protein, 700 aa, Saccharomyces cerevisiae
MVAQYTVPVGKAANEHETAPRRNYQCREKPLVRPPNTKCSTVYEFVLECFQKNKNSNAMGWRDVKEIHEESKSVMKKVDGKETSVEKKWMYYELSHYHYNSFDQLTDIMHEIGRGLVKIGLKPNDDDKLHLYAATSHKWMKMFLGAQSQGIPVVTAYDTLGEKGLIHSLVQTGSKAIFTDNSLLPSLIKPVQAAQDVKYIIHFDSISSEDRRQSGKIYQSAHDAINRIKEVRPDIKTFSFDDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGALGNLVFKKIRTATGGQLRYLLNGGSPISRDAQEFITNLICPMLIGYGLTETCASTTILDPANFELGVAGDLTGCVTVKLVDVEELGYFAKNNQGEVWITGANVTPEYYKNEEETSQALTSDGWFKTGDIGEWEANGHLKIIDRKKNLVKTMNGEYIALEKLESVYRSNEYVANICVYADQSKTKPVGIIVPNHAPLTKLAKKLGIMEQKDSSINIENYLEDAKLIKAVYSDLLKTGKDQGLVGIELLAGIVFFDGEWTPQNGFVTSAQKLKRKDILNAVKDKVDAVYSSS

SEQ ID NO: 5 - DNA, 2085 bp, Saccharomyces cerevisiae
  CDS (1)..(2085): Gene ID 854808 encoding FAA3 [PI No: P39002]
atgtccgaacaacactctgtcgcagtcggtaaagctgctaatgagcacgagactgcccctaggagaaatgttagagtcaagaagcggcccttaattagaccattgaactcgtcagcatctacgctgtatgaatttgccctagagtgtttcaacaagggtggaaaacgagatggtatggcttggagagatgtcatcgagattcatgagacaaagaaaaccattgtgagaaaggtagacggcaaggataaatctatagaaaagacatggctgtattatgaaatgtcaccatataaaatgatgacctaccaggaactgatctgggtgatgcacgatatgggccgtgggctggcaaaaataggcatcaagcccaatggagaacacaaattccacatcttcgcatctacttcccataaatggatgaagattttccttggttgcatatcccagggtatccccgtagtaaccgcgtatgatactttgggtgagagcggtttgattcactccatggttgaaaccgagtctgctgctattttcactgataatcaattattggctaaaatgatagtgcctttgcaatctgctaaagatatcaaatttcttatccataacgaacctatcgaccccaatgacagaagacaaaacggcaaactttacaaggctgctaaggatgccattaataagatcagagaagttaggccagacataaaaatttatagttttgaagaagttgtcaagataggtaaaaaaagtaaagatgaggtcaaacttcatccacctgagccaaaagatttggcttgtatcatgtacacctcgggctcgatcagtgcaccaaaaggtgtagtattgactcattataatattgtttcgggtatcgctggtgtaggtcacaacgtctttggatggatcggctctacagaccgtgttttgtcgttcttgccattggctcatatttttgaactggtctttgaattcgaagccttttactggaacggtattcttgggtacggtagtgttaagactttgactaatacttcgactcgtaattgtaagggtgacctggttgagtttaagcctactattatgatcggtgtggctgccgtttgggaaactgtgagaaaagctattttggaaaagatcagcgatttaactcccgtactccaaaagattttttggtctgcctatagtatgaaagaaaagagtgtaccatgcaccgggtttttaagtcgtatggtcttcaagaaagtcagacaagccaccggtggtcatcttaagtatattatgaacggtgggtctgcgatcagtattgatgctcagaaattcttttctatcgtcctgtgtcctatgattatcggttacggccttactgaaacagttgcgaatgcttgtgttttggagcctgatcatttcgaatatggtatagttggtgatcttgttggatcggtcactgccaaattggtggatgttaaggacctaggttattatgcaaaaaacaatcaaggtgaattgcttctaaagggtgcgccggtctgttctgaatattataagaatccaatagaaacggcggtctctttcacttacgatggatggtttcgtactggtgatattgttgaatggactcccaagggacaacttaaaattattgatagaagaaagaatttggttaaaaccctaaatggtgaatatattgcattagaaaagttagaatctgtttacaggtcaaactcctatgtgaaaaatatctgtgtttatgccgatgaaagtagggttaaaccggtgggtattgtggtacccaacccaggacccctatctaaatttgctgtcaaattgcgtattatgaaaaagggtgaagacatcgaaaactatatccatgacaaagcattacgaaatgctgttttcaaagagatgatcgcaacagccaaatctcaaggtttggttggtattgaactattatgtggtattgttttctttgatgaagaatggacacctgaaaatggctttgtcacatctgctcaaaaattaaagagaagagaaatcttagccgctgttaaatcagaagtcgaaagggtttacaaagaaaattcttag

SEQ ID NO: 6 - protein, 694 aa, Saccharomyces cerevisiae
MSEQHSVAVGKAANEHETAPRRNVRVKKRPLIRPLNSSASTLYEFALECFNKGGKRDGMAWRDVIEIHETKKTIVRKVDGKDKSIEKTWLYYEMSPYKMMTYQELIWVMHDMGRGLAKIGIKPNGEHKFHIFASTSHKWMKIFLGCISQGIPVVTAYDTLGESGLIHSMVETESAAIFTDNQLLAKMIVPLQSAKDIKFLIHNEPIDPNDRRQNGKLYKAAKDAINKIREVRPDIKIYSFEEVVKIGKKSKDEVKLHPPEPKDLACIMYTSGSISAPKGVVLTHYNIVSGIAGVGHNVFGWIGSTDRVLSFLPLAHIFELVFEFEAFYWNGILGYGSVKTLTNTSTRNCKGDLVEFKPTIMIGVAAVWETVRKAILEKISDLTPVLQKIFWSAYSMKEKSVPCTGFLSRMVFKKVRQATGGHLKYIMNGGSAISIDAQKFFSIVLCPMIIGYGLTETVANACVLEPDHFEYGIVGDLVGSVTAKLVDVKDLGYYAKNNQGELLLKGAPVCSEYYKNPIETAVSFTYDGWFRTGDIVEWTPKGQLKIIDRRKNLVKTLNGEYIALEKLESVYRSNSYVKNICVYADESRVKPVGIVVPNPGPLSKFAVKLRIMKKGEDIENYIHDKALRNAVFKEMIATAKSQGLVGIELLCGIVFFDEEWTPENGFVTSAQKLKRREILAAVKSEVERVYKENS

SEQ ID NO: 7 - DNA, 2085 bp, Saccharomyces cerevisiae
  CDS (1)..(2085): Gene ID 855288 encoding FAA4 [Protein ID - P47912]
atgaccgaacaatattccgttgcagttggcgaagccgccaatgagcatgaaaccgctccaagaagaaatatcagggttaaagaccagcctttgattagacccataaactcctcagcatctacactgtacgaattcgccctggaatgttttaccaagggtggtaagagagacggtatggcatggagagatattatagatatacatgagacgaaaaaaaccatagtcaagagggtggatggtaaggataagcccatcgaaaaaacatggttgtactacgaactgactccctacataaccatgacatacgaggagatgatctgcgtaatgcacgacattggacgtgggctgataaagattggtgttaaacctaacggtgagaacaagttccacatctttgcctctacttctcacaagtggatgaaaacttttcttggttgcatgtcacaaggtattcctgtggtcaccgcgtacgacactttgggtgagagcggtttgattcactccatggtggaaacagattccgtcgccattttcacggacaaccagctgttgtccaaattagcagttcctttgaaaaccgccaagaacgtaaaattcgtcattcacaacgaacccatcgatccaagtgacaaaagacaaaatggtaagctttacaaggctgccaaggatgctgttgacaaaatcaaggaagttagaccggacataaaaatctacagtttcgatgaaattattgagataggtaaaaaggccaaggacgaggttgaattgcatttccccaagcctgaagatccagcttgtatcatgtacacttctggttccactggtacaccaaagggtgtggtattgacacattacaacattgtagctggtattggtggtgtgggccataacgttatcggatggattggcccaacagaccgtattatcgcattcttgccattggctcatatttttgaattaacctttgaattcgaagcgttctactggaatggtatcctagggtacgccaatgtcaagactttaaccccaacttctacacgtaattgccaaggtgacctgatggagtttaaacctaccgtaatggtgggtgtcgccgcagtttgggaaacagtgagaaaaggtatcctggccaagatcaacgaattgcccggttggtctcaaacgcttttctggactgtctatgctttgaaagagagaaatataccatgtagcggcttgctgagtgggttgatcttcaagagaatcagagaagcaaccggtggaaacttaaggtttattctgaacggtgggtctgcaatcagcatagacgcccaaaaattcctctccaaccttctatgtcctatgctcattggatatgggctaactgagggtgtggctaatgcctgtgtcctggagcctgaacattttgattacggtattgctggtgaccttgtcggaactattacagctaaattggtggatgtcgaagatttgggctattttgccaagaataatcaaggtgaattgctgtttaagggtgcacccatctgttctgaatactataagaatcctgaagaaactgctgcggcctttaccgatgatggctggttccgtaccggtgatatcgctgaatggacccccaagggacaagttaagatcattgatagaaagaaaaatttggttaagaccttaaatggtgagtacattgcattggaaaaattagaatccatttacagatcaaatccttacgtccaaaacatctgtgtctacgctgatgaaaacaaagttaagcctgtcggtattgtggtccctaacttaggacacttgtctaagctggctatcgaattaggtataatggtaccaggtgaagatgtcgaaagctatatccatgaaaagaagctacaggatgccgtttgcaaagatatgctgtcaactgccaaatctcaaggcttgaatggtattgaattattatgtggcattgttttctttgaagaagaatggactccagaaaatggccttgttacatccgcccaaaaattaaagagaagagatattctagcggctgtcaagccagatgtggaaagagtttataaagaaaacacttaa

SEQ ID NO: 8 - protein, 694 aa, Saccharomyces cerevisiae
MTEQYSVAVGEAANEHETAPRRNIRVKDQPLIRPINSSASTLYEFALECFTKGGKRDGMAWRDIIDIHETKKTIVKRVDGKDKPIEKTWLYYELTPYITMTYEEMICVMHDIGRGLIKIGVKPNGENKFHIFASTSHKWMKTFLGCMSQGIPVVTAYDTLGESGLIHSMVETDSVAIFTDNQLLSKLAVPLKTAKNVKFVIHNEPIDPSDKRQNGKLYKAAKDAVDKIKEVRPDIKIYSFDEIIEIGKKAKDEVELHFPKPEDPACIMYTSGSTGTPKGVVLTHYNIVAGIGGVGHNVIGWIGPTDRIIAFLPLAHIFELTFEFEAFYWNGILGYANVKTLTPTSTRNCQGDLMEFKPTVMVGVAAVWETVRKGILAKINELPGWSQTLFWTVYALKERNIPCSGLLSGLIFKRIREATGGNLRFILNGGSAISIDAQKFLSNLLCPMLIGYGLTEGVANACVLEPEHFDYGIAGDLVGTITAKLVDVEDLGYFAKNNQGELLFKGAPICSEYYKNPEETAAAFTDDGWFRTGDIAEWTPKGQVKIIDRKKNLVKTLNGEYIALEKLESIYRSNPYVQNICVYADENKVKPVGIVVPNLGHLSKLAIELGIMVPGEDVESYIHEKKLQDAVCKDMLSTAKSQGLNGIELLCGIVFFEEEWTPENGLVTSAQKLKRRDILAAVKPDVERVYKENT

SEQ ID NO: 9 - DNA, 2070 bp, Schizosaccharomyces pombe
  CDS (1)..(2070): Gene ID: 2541350 encoding FAA [Protein ID - Q9P7D7]
atggatattaaggactattactgcgtcgaaacaaaggattctaagcaacccggcgaatcctacatatatcgctctatccactcggcgggaaagcttttagatactccagaagacggtgtcagcaccgtttatgacttactgtgtactgcggctaaaaaccatggcgagaaacaagctatgggcagtcgtaaactcatcaaagagaacagagaggagcgagaaattattaggaaagttgacaacgaagaggttgttgagaaaaagttgtggactacctacgagctgggtccttacgaatatatttcttttaataaggtctatgagattgctcttgcacttggttctggtcttgtagcctcgggaataacttcagagactacaatgctattttttgctgccaccagtgccaaatggttcacgactgctcaaggttgcagttcacaagccattcctattgtaactgcttatgaaacccttggtgaagatggtatatacacgtccctcgacgagtgtaagtctagggctattttcaccgatcccaacttaattcccaaattacttggtcccttgaaacaatcaacttgggtaaagcttattgtttgcagctctactcctagtgaagatttagttgaattggttaagtctaccgctcctgatgttgaaatcatcacttatgataatttactttctttaggtaaagaaaaaccccaacctcctcatcctcctaaagccgatgacatttgctgttatatgtatacatctggctcaaccggtaaacccaaaggtgttgttttgttacatcgcaacatcattgccgcattgggcggtatcaatcgcattttgagccaacatattaatgtcaaagattatgtccttgcttatcttcctttagcccatatttttgagtttatttttgagatgtgctgcctttactggggcggagttttgggttatgcgtctcctcgcaccttgacggatgctagtgttgttaattgcaaaggtgaccttactgaatttaggcctactgttttaattggcgttcccgccgtgtatgaacttatcaagaagggaattttagctaaagtctcttccatgcctgcacatagacaaaaggtattttctggttcccttagcttgaagcaatatttaatcgaaagaaatcttcctggttcagccgctcttgatgccattgtcttcaacaaggtcaaggcagctactggaggtagacttcgatactgcatttctggtggtgctgcattagcagctagtacacaagcttttttaagttcctgcatttgccctgtgcttcctggttacggacttactgaaacttgtgctggaagttttgtactttctccagaacagtggcatttatatgctaatacagttggtttccctattccttctatcgaatttaaactagtagacattccagatttaggatactataccgattcctccccacctcgtggtgaagtttggattcgtggacctgctgtttgcaatggatatctcaatcgtcctgaagataacaaggccgcatttactgaagatggatggttcaagactggtgacgttggtgaaattgcaaaaggcaatactctgcgtttgatcgatcggaaaaagaatattgtgaaatctctcaatggtgaatatattgcacttgagaaaatcgaagcacaattttttacaagtcctttagtttcaaatgtttgtgcttatgcagatgtcaatcatgctaagccagtcgttattgtcaaccccgatgaaaatggtttacgcacctacctgactaaaaacagtggttcttcatttaacggcaatcctaatgatacactgactaatctctgtaaggacagtggtgttcaacatcttatccttaaggaattgattaacattggaaagcaacaacgtcttgcttcaattgaaattcctgaaggcgttgttctcagtgactttgaatggactgcggaaaataatttcttgactgcatctcgtaaagtgaaacgtcaagttattgtagcacactactcagacgaaattcagaaggcttatagtaaaaaacattga

SEQ ID NO: 10 - protein, 689 aa, Schizosaccharomyces pombe
MDIKDYYCVETKDSKQPGESYIYRSIHSAGKLLDTPEDGVSTVYDLLCTAAKNHGEKQAMGSRKLIKENREEREIIRKVDNEEVVEKKLWTTYELGPYEYISFNKVYEIALALGSGLVASGITSETTMLFFAATSAKWFTTAQGCSSQAIPIVTAYETLGEDGIYTSLDECKSRAIFTDPNLIPKLLGPLKQSTWVKLIVCSSTPSEDLVELVKSTAPDVEIITYDNLLSLGKEKPQPPHPPKADDICCYMYTSGSTGKPKGVVLLHRNIIAALGGINRILSQHINVKDYVLAYLPLAHIFEFIFEMCCLYWGGVLGYASPRTLTDASVVNCKGDLTEFRPTVLIGVPAVYELIKKGILAKVSSMPAHRQKVFSGSLSLKQYLIERNLPGSAALDAIVFNKVKAATGGRLRYCISGGAALAASTQAFLSSCICPVLPGYGLTETCAGSFVLSPEQWHLYANTVGFPIPSIEFKLVDIPDLGYYTDSSPPRGEVWIRGPAVCNGYLNRPEDNKAAFTEDGWFKTGDVGEIAKGNTLRLIDRKKNIVKSLNGEYIALEKIEAQFFTSPLVSNVCAYADVNHAKPVVIVNPDENGLRTYLTKNSGSSFNGNPNDTLTNLCKDSGVQHLILKELINIGKQQRLASIEIPEGVVLSDFEWTAENNFLTASRKVKRQVIVAHYSDEIQKAYSKKH

SEQ ID NO: 11 - DNA, 1935 bp, Crytococcus neoformans
  CDS (1)..(1935): Gene ID: 3257561 encoding FAA [Protein ID - Q5KH65]
atgaaacggagccgcgcgcgacgaaagatccatcgggtgtgcctggctctgaatatccggagtcgaaatgttgacacatggaacatttctttgtcggccatggaaaagcagctcagcatagcagagtgtgaccgcatcttgacaggtcctggctctccgatggagaccgaggagaaggtgatctttggtagacgtctgactgtatggaagcatctgccctcaacgtttcgagacttcctgatcttcaaccttcagaagtactctcagagagagttcatatcatcgcctttacctctaagggaacctttcaaatcatccgaaacccttactgacaaagtcgatccaagagaacacctgacttttggtgatgttttggaccgttcactgaaattggcagcatggatgcgcagtcgagggataaaaatgggggatagggtagtaattgggggtaaaaactgtactggctggatcgtgtcgtttatcgctgtccatctgatcggcgcagtcactgtgtgcttgaattgctgggttccaagagagcaaatggtttactcaataaagatggtcgagccgagcttagcacttctggacgaagagcgcgcagagatcctcggcccattcacccacgtcaaggagaatggccttcctcctatgttctgctgggcagaatcaggacatttaccttcggttgtggagatctacagcacccccaacaatcaacggacaaaagaagttttggatggcgtgggtctcgatggacttggacccgaaagcgatgctgtcattttctattcctctgggacgagtggcttcccgaaagctgttctgagtactcaacggatggccttgtccaacgccatctctggcatggtcgccacggcccgagcagtccttcgcgccggccttcccctccctcagccgcccaagccgactgacccccaacgagtcgttctcctttcaatcccccttttccacgttactggttgtctctcctggcttctccgtgcaatcactaatggttcaaaatttgtcacctctcgaaagtgggatgtcaaggaagctgtgaggctgattgttgaggaaggggttcataccgtgggaggtgtaccggctattgccagtcagattttacagtcgcctgacctacccgataacactaccctcgacagcatcttttacggaggagcgcctcctagcaaacacatggccaatgaagtgaggaaacgatggcccaaagcagctgtcatccatggatacggtttgacagagacaaacgctgttgcttgcgccgtctgtggtgccgactatctttcacgtcctgacagcactggccctcctgtacccatctgcgaaatccgcattgtaaaccccgatactcgaaaagcattgcccacgggccagcaaggacttattctgatcaaaggcgctcaggtcatgaaatgttattacgggaatgagcaggccacgaagcaagcaattgatgaggagggctggttggatacaggtgatgctggatatctcgatgaagaagggttcttgttcatcaaagatcgcttgaaggatctcattatccgcggcggcgagaacatcgcatcagtggacgtggaaaacgcccttacctctcatccgcatattgacgaagtcgcagcaatcgcccttccacatccgatccttggggaagttgtgggtgctgcagtcacgcttcgtgaatctgcaaaggcaagaggggtaaaggtgacggaagaaagtatcttgggacatgtcagaagtaaactgccgaaacatgccgtgcctgccatggtaatgatttgggaagggagtctgccgaaaaacgtgaatggtaaaaccatgaagaaggaaatcaaaagtgtagccatcaaagaatgggaacgaaggcagggtgcgaatagcaggggagccaaagcgaagctttaa

SEQ ID NO: 12 - protein, 644 aa, Crytococcus neoformans
MKRSRARRKIHRVCLALNIRSRNVDTWNISLSAMEKQLSIAECDRILTGPGSPMETEEKVIFGRRLTVWKHLPSTFRDFLIFNLQKYSQREFISSPLPLREPFKSSETLTDKVDPREHLTFGDVLDRSLKLAAWMRSRGIKMGDRVVIGGKNCTGWIVSFIAVHLIGAVTVCLNCWVPREQMVYSIKMVEPSLALLDEERAEILGPFTHVKENGLPPMFCWAESGHLPSVVEIYSTPNNQRTKEVLDGVGLDGLGPESDAVIFYSSGTSGFPKAVLSTQRMALSNAISGMVATARAVLRAGLPLPQPPKPTDPQRVVLLSIPLFHVTGCLSWLLRAITNGSKFVTSRKWDVKEAVRLIVEEGVHTVGGVPAIASQILQSPDLPDNTTLDSIFYGGAPPSKHMANEVRKRWPKAAVIHGYGLTETNAVACAVCGADYLSRPDSTGPPVPICEIRIVNPDTRKALPTGQQGLILIKGAQVMKCYYGNEQATKQAIDEEGWLDTGDAGYLDEEGFLFIKDRLKDLIIRGGENIASVDVENALTSHPHIDEVAAIALPHPILGEVVGAAVTLRESAKARGVKVTEESILGHVRSKLPKHAVPAMVMIWEGSLPKNVNGKTMKKEIKSVAIKEWERRQGANSRGAKAKL

SEQ ID NO: 13 - DNA, 2091 bp, Candida tropicalis
  CDS (1)..(2091): Gene ID: 8300178 encoding FAA [Protein ID - C5MID6]
atgggtgcccctttaacagttgctgttggtgaagccaaaccaggtgaaaccgctccaagaagaaaagcttctcaaaaattagctccagtagaacgtcctactgattcaaaagcaacaacattgcctgaattcattgaagaatgttttactagaaatggtaatagagatgcaatggcttggagagatttattagaagttcatgttgaaaccaaaaaagtcaccaagatcattgatggtgaacagaagaaagttgataaagaatggatctattatgaaatgggtccttacaactacatctcctatcctaaattattacaattggttaaaaactattccaaaggtttattagaattgggtttattgccagatcaacaatccaaattgatgatttttgcctccacttctcacaaatggatgcaaacctttttggcatcaagtttccaaggtatcccagtggttactgcttatgatactttgggtgaatcaggtttaacccattctttggtccaaaccgaatccgacgccattttcaccgataatcaattgttgggatcattgattcgtccgttggaaaaggctaccgccatcaaatacattatccatggtgaaaagattgatccaaatgacaagagacaaggcggtaagatttaccaggatgctgaaaaggccaaggaaaagattttacaaattagaccagatatcaagtttatttcctataatgaagttattgctttgggtgaaaaatcatccaaagaattgcattacccaaaaccagaagattcaatttgtatcatgtacacatctggttccactggtgatccaaaaggggttgtcattaccaatcacaatattgttgctgctgttggtggtatttctaccaatgccactagagatttggttagacctctggacaaagttgttgcatttttgccattggctcatattttcgaattggcttttgaattgattaccttctggtggggtgccccattgggttacgccaatgttaaaaccttgactgatgcttcttgtagaaactgtcaacctgatttgattgaatttaaaccaacaattatggttggtgttgctgccgtttgggaatctgtcagaaagggtgttttatctaaattgaaacaagcctccccattacaacaaaagatcttttgggctgcttttaaagctaaatctacattgaaccattttggattaccaggtggtggtatgtttgatgttattttcaaaaaagtcaaggctgctactggtggtcaattgcgttatgtattgaacggtggttccccaatttctattgatgctcaagtatttatttccacattacttgccccaatgttgttgggatatggtttaactgaaacttgtgccaacactactattactgaacacacacgtttccaaattggtactttgggtgctttggttgggtcagttactgctaaattggttgatgttgctgatgctggttactttgccaagaacaaccaaggggaaatttggttgaaaggtggtccagttgttaaagaatactacaagaatgaagaagaaaccaaagccgcattcactgatgatggctggttcaagactggtgatattggtgaatggacttctgaaggtggtttgaatatcattgatcgtaaaaagaatttggttaaaactttaaacggggaatatattgctttagaaaaattggaaagtgtttaccgttccaaccatttggtgatgaatttgtgtgtttatgctgatcaaaccaaagttaaaccaattgctattgttttaccaattgaagccaacttgaagaccatgttgaaggatgaaaaggttgttccagatgctgatactcaagaattgagtcatttagtacacaacaaaaaggttgttcaagctgttttgagacacttgcttcaaactggtaaacaacaaggattaaaaggtattgaattgttacaaaatatcgttttgttggatgaagaatggactccacaaaatggtttcgttacatctgctcaaaagttacaaagaaagaagattttagaaagttgtagaaaagaagttgatgaagcttacaagtcatcttag

SEQ ID NO: 14 - protein, 696 aa, Candida tropicalis
MGAPLTVAVGEAKPGETAPRRKASQKLAPVERPTDSKATTLPEFIEECFTRNGNRDAMAWRDLLEVHVETKKVTKIIDGEQKKVDKEWIYYEMGPYNYISYPKLLQLVKNYSKGLLELGLLPDQQSKLMIFASTSHKWMQTFLASSFQGIPVVTAYDTLGESGLTHSLVQTESDAIFTDNQLLGSLIRPLEKATAIKYIIHGEKIDPNDKRQGGKIYQDAEKAKEKILQIRPDIKFISYNEVIALGEKSSKELHYPKPEDSICIMYTSGSTGDPKGVVITNHNIVAAVGGISTNATRDLVRPLDKVVAFLPLAHIFELAFELITFWWGAPLGYANVKTLTDASCRNCQPDLIEFKPTIMVGVAAVWESVRKGVLSKLKQASPLQQKIFWAAFKAKSTLNHFGLPGGGMFDVIFKKVKAATGGQLRYVLNGGSPISIDAQVFISTLLAPMLLGYGLTETCANTTITEHTRFQIGTLGALVGSVTAKLVDVADAGYFAKNNQGEIWLKGGPVVKEYYKNEEETKAAFTDDGWFKTGDIGEWTSEGGLNIIDRKKNLVKTLNGEYIALEKLESVYRSNHLVMNLCVYADQTKVKPIAIVLPIEANLKTMLKDEKVVPDADTQELSHLVHNKKVVQAVLRHLLQTGKQQGLKGIELLQNIVLLDEEWTPQNGFVTSAQKLQRKKILESCRKEVDEAYKSS

SEQ ID NO: 15 - DNA, 14286 bp, Aspergillus nidulans
  CDS (1)..(14286): GeneID: 2876383 encoding FAA [Protein ID - Q5BFS3 ]
atggcaatggggaaacgtaagctggctggctcgttccgcagatatgtcgctaccgggctttctcgggtctcgggcgcttttcggagtcgcagtgccagtaaggaacgccagagccgtggcagcggcagcttggtcgaacgtgatacgctggcaaaagaccagggccagggggtctgtttacagccagctcaagttggagctgtccctgtcactaaggtcccggcgcttgatacgatcgaagcatatgccggagcatttgataaaccaattgacggggccggtacgtgccagcggacaagtttggtctgcagtgccagctctgccgttgacggtgacgtgattgacggcttggttcagggctatgcgcggttcatcgctggattgacgggtcttgacgatatcgcgttctactccactcgtcatgaaccgtttgcattggagaagtcgacatcaatcattatcgcttctgctgcttccaacgagttagtctgtcgtgaggtggacacgaaccacgagaacgatgtgcagttctatgctgagctgggacgggtcgagcctgagaatggacgacgtgaattccagccgaatgcattcacactcttcatcgagccggacagcaataggaagaagaagaatgttcttcaccttagcttcgcctatcctcgacggctgatcccagatgcagcggtagaacagctactgcgcacgcttttactgcacatctgcgagtcttctccactaaagtcgccatcgacatcgcagcctgaattgtccattctgaatttcccgccgtctatgatacccccaactgcgcaggcgaacggcgtcgagaattcgacgaccaacccgcatctcttgcattccgcattcgagaactgggctcgcaagaacccgcattttatcgcattagatttcattcattccctttcatccaaaacgcacagatcagagcatagcatcatcacttatgcggccctcgatagcgctgctaccaatctagccttccatattagatcacttctacgcgactctcgaaaacatggacagattatccctgttcacatgcccacttcaccggagctctacatctcatacctcgccgtcctgaaagctggccacgctttctgtcctatacctcaagacgttcctgcccgacgaatacaggagattcttagcgatattgatgctcctattgtcctcgggacctcatcaaaaccgcccatcagtgctgaaagctcccggtcgacgtctacatgggttaatgtcaccgaagtttccaaatggcggcagatgtgtggcgagcaaccagctgattattctcgaccctctttagaccacataaccattgagcagaaccagactgcttatctcctcttcaccagcggttcaaccggtaagccgaaaggtgtgcaaatcagccatctcgcagcatcatgctccatatcctcccacgccactgcaattcctctccccggcgaatcaccaggcaacttccgctggttccagtttgcttcgccatccttcgacccttcactcatggagatttttgtcaccctaagcactggtggcacgctctgctctgctgatcgcagacttaccctcgccaatctcgaagccaccatcaatgagagcagagcgacagtcatgatggctacgccgagtcttgccacgcttctcagacctgaccggctggagacccttgaggcgctgtggtccatgggagaaaagctcaaccggacagttattgacaacttcgcgctggataatgttatgaatggagacgccgagaccagaagaccgaggaccttggtcaatgcatacggtccaacggaaggagcaatcaactgtacctacgtcgctcccttcaagcgtcacatgcgtggttctatcattggacggccgctaccaacctgtgcgatgtttattctatcccccgactcccaagtccctgtcttagtccctaccggtacagttggagaactggcaattggcggcccccaagtcagcaaaggctatctcaatctccccgaagtaacagctagagtcttcattcgcagcaaggaatttggacccctctaccgcactggcgacaaggcccgcatcgtctgggacgaaagcgggcaccaggtcattgagtacctaggccgaatccgcacggatcaggtcaagataaatggacgcagagttgagctgggtgaaattgagtctgttgtcgcggctgtggagggtgttcgggaggccgttgcggttgtggtaaagagagatagcaagtcaaacgggggcgagcagattgtcgcttgtcttgtggtagatgctgcggatggggaggggcgtgagaaaattgcacagcaagcaaaaaaaaatgctgcgcagcatcttgcgagcttcatgtgcccgactacctacacattttttgatgtgctgcccaggtcgagttccggaaaggtcgatcgaaaagcgttggctgtccagctgcaagagaagcctgatgttccaatcaagaatggcctcagtgaagaaagtgcagaatgttggaggcattcagatgaggccgcatcgtcagtacagcagctggtgattcgactcgttgcggaaacaggggacgtgagtgattccgcaataaagcccgggacagagctgtactcggtaggcatcgacagtctaggagcaatgcgttttctacagaagctgagagacaatggggtccatgggctgtccgtcggcgaagtgctgcaaacacatacatgccagcggcttgtctctctcgtccagagcatgctgacgaatcaaaatggcgagcctaatgggatacttcagaagggcagtataacaaacgacttgcagttaagactgcagtcattcggccggcgatatcgcatgttttgcgcagaatcccttgacgtgcccgcggacacgatacatgaagtccttcctaccactgctactcaatccgggatgttgactagttttctgcgtagctctgcggaacagtcctatgagaaaccaacatacatttatcatactgtccttccacttgagccccgtaccaacattgagaagctcaagaaggcctggttcgatgttatctcaaactatgactctttccggacggtcttctgtatggtcgacgatgagctggccccgtttgcacagtgcatcttgacggctgagggcgtctcatccagggactggaacgtttacacaagccctaacagatcatcgacgaagtccatcatgatcctcagcatgttccacggaatcttcgacggcggctctctacagctcctcttgcaagatgtctcgtcagcgtactccggaaacacactaccgcagcgaacctcactaacccacatcgtcaaacaccacttccaggcagatcacacttccacatccaaattctggagggaatatctacaaggttactctctcctcccctttccatctctcactccgcatcgagcgccggcccagaaaagcactggctgtgctgaggtcacctctcaactcagttacggagccctcaaaaaactctcaaaaagcattggctctacaccactctctgtgctgcaggcagcatggggtgcggtagttctcagctacacagctacgccggatcaggacgtagttttgggaagtgtgatgtctggacgacttgatcccgattcgaaagactgcattggtccgacctttacgataacgccttccagaatttccgtccagcaattgaagggttccggatccttgacaaaccaatcagtggtccactatctgtcgtcttcaaatgcaaaagcgctctcacacctccagcctcagctaggatctgtgaccgtaaatggcaaggttccctatgacacagtcctcgcataccaggactttgacactgatatgaaaccttctcaaacctggagttctgtccaacatcccgctatggcaaatgatttctctgtgatgatcgaggtggtccccaatccggactcgacgttgacgctgcgggctagtttcgacacgaaactcgactctaccggagctcaaatcatgctgaaacaaatggatgatatcgtcagctacatcctcaaccacccggactcgagtttcgaagatgctcctcttcaagccagcttagctctgaaatcgaaagcgaaccccagtccaattacagctccagaagtcagcgaaggagcactcctacaatcacagttcgaagaccatgccctctcgcatccaaatgacccagctctagtatttaagcaggaccttgataatgatgatcatccaggaaacatcacttggacatatgcccaactcaacgctatggctgaagctcttgcggaacatctgctccaggtttgtggtgatctgagagatgcttctgttccgatttgcatcgagaagagtccacccttgtatgttgcgatcctaggtatcctcaaggcaggaggcgcctggtgtcccattgatacactttccccagcacagcgtcgccatgatctcattgcgcgaactagtgccggtatccttctggtttctggtctcgatacgccacaacctcagaatgctgttccagctggagtcagagttattgatgttagcaagttcattcagaatgtctcgagcgacaataccccacagtcaagcagacaccgagcaacccctagaaatacagcctacctaatctggacgagtggcacaactggcgctcccaagggcgtacccattacgcactcagccgccgtctctagcatgcgctccctccagaccgatatcccgggtaacgaagacggcagtcccattcgctgcctccaattctcgcaaccaaccttcgatgtctccatccaagacctcttctacacttggggcttaggaggcgcgcttatttctggcacgagggagataatgctcgaatctttccctaaacttgcaaatatcaccaaggcaacgcacgcccatctcacgcctgcctttgcggctggtgtcgcgaggaaatcatgcaaaacgcttaaagtcgtaacaatgatcggcgaaaaattgacacagagtgttgcggatgattgggggacagacatgagggcgttcaatacctacggccccgcggaggcgacggtcgtcagtacgatccgcgaattcggcaatgaacatagatccgtcaaaagtgcgaatatcgggtggccaatgagcagtgtttcggtcttcgtgatgtccaaagataagcgcgtgctcatgaagaatgccattggagagcttgcattaggtggccctcagctttcaccagaatacttgaatttaaaggacgtaacggacacgaagtatatctggaatgaggacgctgggcagcggctttactatacgggtgaccttgtccgcatgctatctgatgggagtctggagtacatcacgcgtgttgatgaccttgtgaaactaggtggcattaggattgagttgtcggagataagttttgcgctgagagggtgtcatgaactcgtcgagagcgtggagactatgatacttagcaggaaagacaggccagtcagagttgttgttgcgttcttgtgcgccccgaaggctgctggtgatgcggatgaaggtttgttggtgcttgacgacactggtagagatattgcccgtgcagcaagccttcaggcgcgcaatgtcctgccagagaacatgattccctctgtgtatcttattgtcaagaagataccaaaaacgccatctgcaaaggtcgatcgacgcgctttacaggctgcgtacgcagcggttgatattgacaagtgggagaacaacgttaaccctgagggccccggagatgcagatgaggatgatgctgccacggccactcagatcatcgagacagtggcagcgctggtgcatgttgagagctcgactatcacaaagagcaatagattacgcagtctaggtgttgactcactctgtgccacgcgtcttgcatttaggctcaaggaggccgggtttggtctttctgttatggatgtcctggcctgcaccactatccaggatcttgtcagattagcccagtctacttcattcagttcatctgcaaactcagctagccctcacaacgacaagttcgatatcgtctccttcaacaagatatggcataccctcgtcgcagcagcagcaaagatccctgagaaggacgcgtttacaacgatccgcgccacagctatccaggagagcttgcttactgagacaatgggtacatacgacatgtactggagcaatcatttcttcagacttgataggtctgtcgacattccccgactacgacaagcttggtatgccgtgtgccagaagactgagacgctccggacggggtttatacctgtcgcacagacggaggcaaagaataagaaacaggctaaggattcgggattttctattttgcaggttgtgtataagcttccggcggtggattgggaggctcatacctacaggaaggaagagtggagttgggtgctaaagaaccgagtgcgggatatcatgacggcgcaccagaagaactacttctgccatcctccttgggcagtcacaatactggaagaaggcaccgaacgagtcatggtcttgacactccaccactcaatccatgacgagccttccctcaagttcttgatggacgatgtccgcgccgcatatacctacaaaccgcctcttcgcacccagctgacccccgccctcgcgcttgtgctcccaactccaagcaaatacgccgaagctgttgatttctggtccttggagctcaagccgtacgccgccctcgacgtccccgtctggcccgatctcacaggtaaacgggtctcaccaggcgcggcgccagaatacaaactgatatccgaggcgatgtcaataacctcgtccttcccagttttagagaaagtcgcagcagatctagggctgaaatctgttgcgtcgatcattagggcggcatgggcgttcgtcagcctgtcttatctgggcctgtcggggacggtgtttgcggagacgttatcagaccgcgtctttgatccgtccttggaaagcgcagtcggtccttttatatctgttgttccggttccgttccgagtagaaggggatacgacagtgaggaagatcctggcagaacagcaccggctctccttgcaatcgtggaagcatcgacatgttcatgcgagagatattcggaaggcccttaagcggcagagaggagagccgttgtaccctgcagtattcaatttccacgcgcttgacgaatcaaaggacagaaaaattgcgagcctgcctggtctctggcatgagcttgaagaccagattggcctgcatgttgagcatcccatggccatgaatgttttccagtcgccaagcggaaacatgaccctggaggcatcaagcgatagtcggatcttcagccgtgaacatttacgcctttttgttcgccagatcgatgctctcatctcggaaatgctcttatcgcctgatgaatctctcagcgggctcgtgaatcggcttccgtctgacctacgatccctatccaacaggattgtgagccatgaagtcgcgaattcaattcaccaggccccaacttactggctggagaagttcgccgacactcacccgcactggacagccgtcgaggtggcgtccagtatcagtacaaacggaattgaaaaagaagccatgagttatggctctctaaacagcgcagcaaaccgtgttgctgcgtacttggcttcatttaggtacaagaatcgagtcgtcggtgtctgtgcaggacggacattagcgtcgtaccccatcatcattggcatattcaagtccgggaatacataccttcctattgatgagagtctgccagccgatcgaaaggcgttcttgctggaggatgcaaagtgtccggttgtctttacggaactgggtctcaggaattcctttgccggtgctcctgatacctgtcgcgtggagtgtattgacgaccctgccctgcagagatcattggacgaaatgccatcgacaaacaaagactacagctcccatccagatgatgtctcatacctgctattcacttccggctcgaccggcaaacccaaaggcgtcatggtcactcgcgcgaacctgtcgtccttcatcgagtccatatctgagtttgcatgccgcattgcaccagatacgcttaagctgggtggcacaggtcgctatctagcgcaagcaaaccgcgccttcgacccgcacctgctggagatgttcttcccatggcgccatggcatggccactgtgactgccccgcggcctatgatccttgatgatatcgggacgactctatccaaatggagcattacacacgccagtttcgttcccagtctcgtcgaccagagcgacatcacgccccagcaatgccccaacctgcggttcatgacagtgggcggggagaaaatcacacagaaagtcctcgacacctgggcctcagcaccgaacgtggctatcgtgaacgcctatggtcccacggaggtaacgattggctgtacatttgcgcatatcaacccgtccacaaacctacgcaatatcggcccccctcttacagcttgcacagcgcatgttctgatccctgggaccatgaagtacgcacttcggggccagactggcgaattatgtttcagtggtgatcttgtggcgagaggatatctgaatcgccctgatgccactgccgcaaattttatcactggccccaacggtgccaagatgtaccgtaccggtgatatcggccggcttatgtctgatgattcggttgagtaccttggacgtggagatgaccaaaccaagatccgtgggcagagactagaactcggcgaggtttccgaagtactaagagcttcttcgccagttgccgttgatattgtgacgacggtagcgaaacatcctgacctcggcaaggtacagctgattaccttcgtgtcgagagcaaagaagcgcactgtcaatgaggaggtgcagtttctattctctgatttcggtaccctaggccaagaactgcgcgatatttgtgcgaaaaagctgccagcctatatggtcccagacctcatcttgcccgtgacaagtatccccgtcgcggcaatgagcggaaaggcggatatgaaggtattgcaaaaattatttaccgagctgccgttgcaggttgttcttcaggggaataatgctattgcaaacggaactggctccgaacggccgctgaacccagacgagatagccgtcgtcggcgagatttgccaagttatctctgctgactcacacagcttttcgcctatgacgaacatctttgaaattgggattgacagtctcagtgcaattgggctctcggttagactacgtggaattggatatgcggcgagtgtggcggcaattatggccaacccggttgtcgagcagcttgctaggttgcctagagcttctgagcatggagttaatgatcatgcagattattttgcacagcggtgcaaggagttggaaagccagtatcgaagcgtttttagggatgctgtcgaggttgccgtagtcaggccttgtctcccattgcaggaaggactgattgcgcgctctatgaacagtaacagcggcgatggcaagctctatgtcaatcatgtcattctgcagctgaacaaggatgttgacaccagaaagctaaaaagctcttgggaggatgtggcgaaggagaacgagatattgaggacggcgtttgcgccactagagaaggagattgcgcaggttgtcctgtccaatgcttcttatcaaatgcaatggacagaggggaagtatgaagatttggatgaagccattcaagcacgaaatgaaaaacaaggacagatctcgagactcattattgcggatttatcaactgttcctccggcacggttccatcttgccagctcggcgagtgggaagccgctggctttgtttatttcgatacatcacgggctctatgatggcgaatcctttgcgatgatgctggacgaggttgcggcacggtatgaagggaggaaggtcggggagagaggctcaccgtctgtctttttgaggcatgtttgttcccaggacacagaggaggcgaagaggcactggatgcagcaactttctggatgcacccctacaatattccgagccaacggaaatgcaatcaaaaacaccatttccattcgtcgaactggcaacgccaaactctcggacttagaaacccgctcgtcaacactccagacgacagtcccgaacctgctgcaggcagtctttgctctcttgttagcggaccacaccggtattttcgatgtaacctatggccttgtcctgtcaggacgcactatatccgccccaggggcggactcggtacttttaccggctatcaccactatccctgggcgtctcaacatgagcgacttgaaaaccgttaatgacgtggtgaaggttgttcagagagctaccgcgagatctttagacttccagcatacacccctccgcaagatccagcagtggctgaagtccgaagccccattgttcgattgtctgttctcgtatatccgcgccactgctccacctggccataacctctgggcagaattggacagccacatgccgtctgagtacccacttgcccttgaagtgcaagccgataatgcggctaatacactcaaattggagtgcatcttctcctcagactttggaccacggcaagttggtgaggaattccttgagaagatggacgctgttatttctgaagttgtctctggttcaagtttgcctttggagaacttcaacaccgtgcgatcagctacctctgcgtctcatggtgcatccgtacaatgggacgagtcaagctggacttcgtcagaaagcaggatacgagaaataacggcaacgttctgtggactgaatgtcgaggctgtatcaaaaggcgcttcattctttagtcttggcatagactcagtcactgctcttcagtttgccagaaggctgcgtgatgagggattcaaggtttcatcatcggaaattatgcgtttttcctgtgttgggtcgttgacaggacatattgaatcttcttccgcgctgcaaactaatggtattgggaaaacggagacggctatctcaatcgaaacctatgcaaagcatattcctctgcttggaaagaatgactccatcacgtcgttgttcgaatgtacaccactgcaatcaggaatgatcacgcaaacgatcagctctggagggaaggtgtatattaatcctcatccaatccgtctcagggacaacgtgaaagtggagaagctcaaggaggccctgcgtcacgttgttcaggctaacgaaattctgcgcacgtcttttcacctcatcccggatctaggagagagctggattggtgccgtgcatgaagagcctaagtttgagtggagtgagatcaatatgccatcaggcgccaatgctctgtctgaggttatgaacctctatacgttctgtgaagaggcatcttttgagaggccaccgattcgttctgttcttgtcaaccagccaggctataggatcctcatagttgtcctacatcattccctttacgacggtgcttccctaccgttcgtcttcgaggaccttgcaacaatctatgcaggaggaacccttgctcaacgaccacagttctcagaaatggtcccctacatgctctcagggcaagacgaatcctgtgccttctgggtggacaggctcagagactatgtacctgttgagatctgtccactacccaagctcgacagcactccaaatatgctaaccgcgaaaaatcgcattcccctacccctccactcaatcacagaatcctgcaagaccatgtccgtcacaatccaaactgtctccctgctttcctacgcaaaggcctacgcgcaccttctcggaacccgtgacgtcgtgttcggtcaagtcttagccggccgaacactgcctcaccctgaggcagaccgtacattaggaccattattcaacactgtcgcgcaacgaataacgcttgatcccacatttatgagtaactgcgctcttgcgcaacggctccaaagggatggcgtcgaagcacaaagacatcagcatgcaccgctgagaattattcagaatacgctgcgtcaagagggaaatcttgactcgaagcagttgtttgatgcactctttgtgttccagaagagtgccgcgctctctcagggtatcctgaacgagcaggagatttggacatcatatgaagatgaggatttcgtcgttgacgcggaatataaactcaatgtcgaggttgaccattctcacgacggggtcattgttagggctacggcaaatggtgcctaccttaaccagaaaatgcttgagagtttcctcagtcaatacgtcgaggttttctgtgatgtcgtcgagcatcccgcaagatgtgtcacggcggtaccgcagggactgggaggactgccgttagaacgggcgagttcgagattcgggcaaccggtgactgacggctcgaagccggattctgcgccctctacgcctgtgccagtgcatgaggaaaccattcgatctgttctagcagacgtcgtgggaatctctactgacgatatcaagccaaccacgagcattttcaacctcgggcttgactctctttcagctatcaggctcgcttctctttgccgcacaaagggtttgaaagtcagtgttggggatattcttcaggggaatacgctgcgcggtataagtacgcgtgtgcagttagaatccgaagtctctaccacgacaaacgggcacaacccagttcatggaacttcgtccttgattaaggattatcctcacgtcgaacaaaccgtcatctctaatctgcatctcagcaaagaagagatcgaaacaattatccccgttctccctggccaatttcaccacctggttggctggctcaagtcagaccggaaactgttcgaagcaccctgggcttttgtcgctcgtgatgataagcgtatcaatgccgataagctccagtgtgcgtgggccgatcttcgcaagcgacatcctgtgctacggacggcctttgcagctacctcggactcagaggctgtgcagattgttctgagaacacctgcagaaaactcggatgcattcagagtcatcgaatctgcggacaatattgccgacctagccagagcgcacgcccgcgaggaagcgttgcacccatcctccctctcttccccgcctgtgcgattacggcacctcaaggctgcggatagggatggcatcctgcttattatccatcactctctgtacgatgcatggagcattccgatgcttgtctctgaacttggtaaactctacgacgatcagccaacagattttaccacagccccagacttccctgccctcgtggacttttcacttcgtgctctctccaacctcgatgtcaacgagaaggattactggacctcgactcttaagcccgctacaccgactcttgtcaggagcgccggtacgcagaaatcaattgcaaacaacgaacagttgttcgttggcgaatgggaaagagtctccaatctatctacgatggagaaaatatgtcgatccgcgggattcagccttcagacgatcatcctcctcgctgttgcgcgctgccttgcgagatccactggcgttgagagccccgtcatgggactctatcagaatgggcgcttggctgcgttcgatggaattgaaagggtcccgggaccctgtttgaacgtcaatccgtttgttgtggaggatgtgttaaccagtctgggcaatgaagagaaagagtgtgtcctcaagcaggcgagaaacattcagagatccctcgcagaacgggtaccgtatgagcagagttcgcttcgtaaagtcctaacatggcttaacccggaaaatggagaggtaacaccgctattcaatatgtgggttaatctgctttggatgcaggacagcacttcctccacccccagccagcaagccaatgacgagaaaagtgaagccgggttcttcaaaccccttcgcatcggcgttccgacagacttcattccttctaagccgctacccccatcatctacatcgatagatagcctcgatacatcttacttgccagaccagaatatcttccttgatattggtcccgatccagccacggatagtattggctttggggtccgtgttgagggtggcttgctggcagagggtgaggtcaaagagcttgtggacgcgattgccgctgagattgaaagagctgttgcttgcttaaaagcttaa

SEQ ID NO: 16 - protein, 4761 aa, Aspergillus nidulans
MAMGKRKLAGSFRRYVATGLSRVSGAFRSRSASKERQSRGSGSLVERDTLAKDQGQGVCLQPAQVGAVPVTKVPALDTIEAYAGAFDKPIDGAGTCQRTSLVCSASSAVDGDVIDGLVQGYARFIAGLTGLDDIAFYSTRHEPFALEKSTSIIIASAASNELVCREVDTNHENDVQFYAELGRVEPENGRREFQPNAFTLFIEPDSNRKKKNVLHLSFAYPRRLIPDAAVEQLLRTLLLHICESSPLKSPSTSQPELSILNFPPSMIPPTAQANGVENSTTNPHLLHSAFENWARKNPHFIALDFIHSLSSKTHRSEHSIITYAALDSAATNLAFHIRSLLRDSRKHGQIIPVHMPTSPELYISYLAVLKAGHAFCPIPQDVPARRIQEILSDIDAPIVLGTSSKPPISAESSRSTSTWVNVTEVSKWRQMCGEQPADYSRPSLDHITIEQNQTAYLLFTSGSTGKPKGVQISHLAASCSISSHATAIPLPGESPGNFRWFQFASPSFDPSLMEIFVTLSTGGTLCSADRRLTLANLEATINESRATVMMATPSLATLLRPDRLETLEALWSMGEKLNRTVIDNFALDNVMNGDAETRRPRTLVNAYGPTEGAINCTYVAPFKRHMRGSIIGRPLPTCAMFILSPDSQVPVLVPTGTVGELAIGGPQVSKGYLNLPEVTARVFIRSKEFGPLYRTGDKARIVWDESGHQVIEYLGRIRTDQVKINGRRVELGEIESVVAAVEGVREAVAVVVKRDSKSNGGEQIVACLVVDAADGEGREKIAQQAKKNAAQHLASFMCPTTYTFFDVLPRSSSGKVDRKALAVQLQEKPDVPIKNGLSEESAECWRHSDEAASSVQQLVIRLVAETGDVSDSAIKPGTELYSVGIDSLGAMRFLQKLRDNGVHGLSVGEVLQTHTCQRLVSLVQSMLTNQNGEPNGILQKGSITNDLQLRLQSFGRRYRMFCAESLDVPADTIHEVLPTTATQSGMLTSFLRSSAEQSYEKPTYIYHTVLPLEPRTNIEKLKKAWFDVISNYDSFRTVFCMVDDELAPFAQCILTAEGVSSRDWNVYTSPNRSSTKSIMILSMFHGIFDGGSLQLLLQDVSSAYSGNTLPQRTSLTHIVKHHFQADHTSTSKFWREYLQGYSLLPFPSLTPHRAPAQKSTGCAEVTSQLSYGALKKLSKSIGSTPLSVLQAAWGAVVLSYTATPDQDVVLGSVMSGRLDPDSKDCIGPTFTITPSRISVQQLKGSGSLTNQSVVHYLSSSNAKALSHLQPQLGSVTVNGKVPYDTVLAYQDFDTDMKPSQTWSSVQHPAMANDFSVMIEVVPNPDSTLTLRASFDTKLDSTGAQIMLKQMDDIVSYILNHPDSSFEDAPLQASLALKSKANPSPITAPEVSEGALLQSQFEDHALSHPNDPALVFKQDLDNDDHPGNITWTYAQLNAMAEALAEHLLQVCGDLRDASVPICIEKSPPLYVAILGILKAGGAWCPIDTLSPAQRRHDLIARTSAGILLVSGLDTPQPQNAVPAGVRVIDVSKFIQNVSSDNTPQSSRHRATPRNTAYLIWTSGTTGAPKGVPITHSAAVSSMRSLQTDIPGNEDGSPIRCLQFSQPTFDVSIQDLFYTWGLGGALISGTREIMLESFPKLANITKATHAHLTPAFAAGVARKSCKTLKVVTMIGEKLTQSVADDWGTDMRAFNTYGPAEATVVSTIREFGNEHRSVKSANIGWPMSSVSVFVMSKDKRVLMKNAIGELALGGPQLSPEYLNLKDVTDTKYIWNEDAGQRLYYTGDLVRMLSDGSLEYITRVDDLVKLGGIRIELSEISFALRGCHELVESVETMILSRKDRPVRVVVAFLCAPKAAGDADEGLLVLDDTGRDIARAASLQARNVLPENMIPSVYLIVKKIPKTPSAKVDRRALQAAYAAVDIDKWENNVNPEGPGDADEDDAATATQIIETVAALVHVESSTITKSNRLRSLGVDSLCATRLAFRLKEAGFGLSVMDVLACTTIQDLVRLAQSTSFSSSANSASPHNDKFDIVSFNKIWHTLVAAAAKIPEKDAFTTIRATAIQESLLTETMGTYDMYWSNHFFRLDRSVDIPRLRQAWYAVCQKTETLRTGFIPVAQTEAKNKKQAKDSGFSILQVVYKLPAVDWEAHTYRKEEWSWVLKNRVRDIMTAHQKNYFCHPPWAVTILEEGTERVMVLTLHHSIHDEPSLKFLMDDVRAAYTYKPPLRTQLTPALALVLPTPSKYAEAVDFWSLELKPYAALDVPVWPDLTGKRVSPGAAPEYKLISEAMSITSSFPVLEKVAADLGLKSVASIIRAAWAFVSLSYLGLSGTVFAETLSDRVFDPSLESAVGPFISVVPVPFRVEGDTTVRKILAEQHRLSLQSWKHRHVHARDIRKALKRQRGEPLYPAVFNFHALDESKDRKIASLPGLWHELEDQIGLHVEHPMAMNVFQSPSGNMTLEASSDSRIFSREHLRLFVRQIDALISEMLLSPDESLSGLVNRLPSDLRSLSNRIVSHEVANSIHQAPTYWLEKFADTHPHWTAVEVASSISTNGIEKEAMSYGSLNSAANRVAAYLASFRYKNRVVGVCAGRTLASYPIIIGIFKSGNTYLPIDESLPADRKAFLLEDAKCPVVFTELGLRNSFAGAPDTCRVECIDDPALQRSLDEMPSTNKDYSSHPDDVSYLLFTSGSTGKPKGVMVTRANLSSFIESISEFACRIAPDTLKLGGTGRYLAQANRAFDPHLLEMFFPWRHGMATVTAPRPMILDDIGTTLSKWSITHASFVPSLVDQSDITPQQCPNLRFMTVGGEKITQKVLDTWASAPNVAIVNAYGPTEVTIGCTFAHINPSTNLRNIGPPLTACTAHVLIPGTMKYALRGQTGELCFSGDLVARGYLNRPDATAANFITGPNGAKMYRTGDIGRLMSDDSVEYLGRGDDQTKIRGQRLELGEVSEVLRASSPVAVDIVTTVAKHPDLGKVQLITFVSRAKKRTVNEEVQFLFSDFGTLGQELRDICAKKLPAYMVPDLILPVTSIPVAAMSGKADMKVLQKLFTELPLQVVLQGNNAIANGTGSERPLNPDEIAVVGEICQVISADSHSFSPMTNIFEIGIDSLSAIGLSVRLRGIGYAASVAAIMANPVVEQLARLPRASEHGVNDHADYFAQRCKELESQYRSVFRDAVEVAVVRPCLPLQEGLIARSMNSNSGDGKLYVNHVILQLNKDVDTRKLKSSWEDVAKENEILRTAFAPLEKEIAQVVLSNASYQMQWTEGKYEDLDEAIQARNEKQGQISRLIIADLSTVPPARFHLASSASGKPLALFISIHHGLYDGESFAMMLDEVAARYEGRKVGERGSPSVFLRHVCSQDTEEAKRHWMQQLSGCTPTIFRANGNAIKNTISIRRTGNAKLSDLETRSSTLQTTVPNLLQAVFALLLADHTGIFDVTYGLVLSGRTISAPGADSVLLPAITTIPGRLNMSDLKTVNDVVKVVQRATARSLDFQHTPLRKIQQWLKSEAPLFDCLFSYIRATAPPGHNLWAELDSHMPSEYPLALEVQADNAANTLKLECIFSSDFGPRQVGEEFLEKMDAVISEVVSGSSLPLENFNTVRSATSASHGASVQWDESSWTSSESRIREITATFCGLNVEAVSKGASFFSLGIDSVTALQFARRLRDEGFKVSSSEIMRFSCVGSLTGHIESSSALQTNGIGKTETAISIETYAKHIPLLGKNDSITSLFECTPLQSGMITQTISSGGKVYINPHPIRLRDNVKVEKLKEALRHVVQANEILRTSFHLIPDLGESWIGAVHEEPKFEWSEINMPSGANALSEVMNLYTFCEEASFERPPIRSVLVNQPGYRILIVVLHHSLYDGASLPFVFEDLATIYAGGTLAQRPQFSEMVPYMLSGQDESCAFWVDRLRDYVPVEICPLPKLDSTPNMLTAKNRIPLPLHSITESCKTMSVTIQTVSLLSYAKAYAHLLGTRDVVFGQVLAGRTLPHPEADRTLGPLFNTVAQRITLDPTFMSNCALAQRLQRDGVEAQRHQHAPLRIIQNTLRQEGNLDSKQLFDALFVFQKSAALSQGILNEQEIWTSYEDEDFVVDAEYKLNVEVDHSHDGVIVRATANGAYLNQKMLESFLSQYVEVFCDVVEHPARCVTAVPQGLGGLPLERASSRFGQPVTDGSKPDSAPSTPVPVHEETIRSVLADVVGISTDDIKPTTSIFNLGLDSLSAIRLASLCRTKGLKVSVGDILQGNTLRGISTRVQLESEVSTTTNGHNPVHGTSSLIKDYPHVEQTVISNLHLSKEEIETIIPVLPGQFHHLVGWLKSDRKLFEAPWAFVARDDKRINADKLQCAWADLRKRHPVLRTAFAATSDSEAVQIVLRTPAENSDAFRVIESADNIADLARAHAREEALHPSSLSSPPVRLRHLKAADRDGILLIIHHSLYDAWSIPMLVSELGKLYDDQPTDFTTAPDFPALVDFSLRALSNLDVNEKDYWTSTLKPATPTLVRSAGTQKSIANNEQLFVGEWERVSNLSTMEKICRSAGFSLQTIILLAVARCLARSTGVESPVMGLYQNGRLAAFDGIERVPGPCLNVNPFVVEDVLTSLGNEEKECVLKQARNIQRSLAERVPYEQSSLRKVLTWLNPENGEVTPLFNMWVNLLWMQDSTSSTPSQQANDEKSEAGFFKPLRIGVPTDFIPSKPLPPSSTSIDSLDTSYLPDQNIFLDIGPDPATDSIGFGVRVEGGLLAEGEVKELVDAIAAEIERAVACLKA

SEQ ID NO: 17 - DNA, 2076 bp, Yarrowia lipolytica
  CDS (1)..(2076): GeneID: 2911089 encoding FAA [ Protein ID - Q6C8Q3]
atggtcggatacacaatttcctcaaagcccgtgtcggtggaggtcggccccgccaagcctggcgagactgccccccgacgaaacgtcattgccaaggacgcccctgtcgtcttccccgacaacgactcgtccctgaccaccgtctacaagctgttcaaaaagtacgccgagatcaacagcgagcgaaaggccatgggatggcgagacaccatcgacatccacgtggagaccaaacaggtgaccaaggtcgtggacggagtggagaagaaggtgcccaaggaatggaagtactttgagatgggcccttacaagtggctctcatacaaggaggcccttaagctggtccatgattatggagctggtcttcgacacctcggaatcaagcccaaggagaagatgcacatttacgcccagacctcccaccgatggatgctctctggcctggcttctctgtctcagggtattcccattgtcactgcctacgacactcttggagaggagggtctcactcgatctctccaggagaccaactcggtcatcatgtttaccgacaaggctctgctgagctctctcaaggtctctctcaagaagggcaccgatctgcgaatcatcatctacggaggtgatctgacccccgacgacaagaaggccggaaacacggagattgacgccatcaaggagattgttccagatatgaagatctacaccatggacgaggttgtcgctctcggccgagaacacccccaccccgtggaggaggtcgactatgaggacctggccttcatcatgtacacctctggttctaccggtgtccccaagggtgtggttctgcagcacaagcagatcctcgcctctgtggccggtgtcaccaagatcattgaccgatctatcatcggcaacacagaccggcttctcaacttcctgcccctcgcacacattttcgagtttgtgttcgagatggtcaccttctggtggggtgcttctctgggttacggaaccgtcaagaccatttccgatctgtccatgaagaactgtaagggagacattcgagagctcaagcccaccatcatggtcggcgttcccgctgtctgggaacctatgcgaaagggtattcttggcaagatcaaggagctgtctcctctgatgcagcgggtcttctgggcctcatttgccgccaagcagcgtctcgacgagaacggactccctggtggatctatcctcgactcgctcattttcaagaaggtcaaggacgccactggaggctgtctccgatacgtgtgtaacggaggtgctccagtatctgtcgacacccagaagttcatcaccactctcatctgtcccatgctgattggatgcggtctgaccgagactacagccaacaccaccatcatgtcgcctaaatcgtacgcctttggcaccattggtgagcccaccgccgccgtgaccctcaagctcattgacgtgcctgaagccggctacttcgccgagaacaaccagggagagctgtgcatcaagggcaacgtcgtgatgaaggagtactacaagaacgaggaggagaccaagaaggcgttctccgacgatggctatttcctcaccggtgatattgccgagtggaccgccaatggccagctcagaatcattgaccgacgaaagaacctcgtcaagacccagaacggagagtacattgctctggagaagctcgagacacagtaccgatcgtcgtcgtacgtggccaacctgtgtgtgtacgccgaccagaaccgagtcaagcccattgctctggtcattcctaacgagggccccaccaagaagcttgcccagagcttgggcgtcgattctgacgactgggacgccgtctgttccaacaaaaaggtggtcaaggctgtgctcaaggacatgctcgataccggccgatctctgggtctgtccggcattgagctgctgcaaggcattgtgttgctgcctggcgagtggactcctcagaacagctacctgactgctgcccagaagctcaaccgaaagaagattgtggatgataacaagaaggaaattgatgagtgctacgagcagtcttag

SEQ ID NO: 18 - protein, 691 aa, Yarrowia lipolytica
MVGYTISSKPVSVEVGPAKPGETAPRRNVIAKDAPVVFPDNDSSLTTVYKLFKKYAEINSERKAMGWRDTIDIHVETKQVTKVVDGVEKKVPKEWKYFEMGPYKWLSYKEALKLVHDYGAGLRHLGIKPKEKMHIYAQTSHRWMLSGLASLSQGIPIVTAYDTLGEEGLTRSLQETNSVIMFTDKALLSSLKVSLKKGTDLRIIIYGGDLTPDDKKAGNTEIDAIKEIVPDMKIYTMDEVVALGREHPHPVEEVDYEDLAFIMYTSGSTGVPKGVVLQHKQILASVAGVTKIIDRSIIGNTDRLLNFLPLAHIFEFVFEMVTFWWGASLGYGTVKTISDLSMKNCKGDIRELKPTIMVGVPAVWEPMRKGILGKIKELSPLMQRVFWASFAAKQRLDENGLPGGSILDSLIFKKVKDATGGCLRYVCNGGAPVSVDTQKFITTLICPMLIGCGLTETTANTTIMSPKSYAFGTIGEPTAAVTLKLIDVPEAGYFAENNQGELCIKGNVVMKEYYKNEEETKKAFSDDGYFLTGDIAEWTANGQLRIIDRRKNLVKTQNGEYIALEKLETQYRSSSYVANLCVYADQNRVKPIALVIPNEGPTKKLAQSLGVDSDDWDAVCSNKKVVKAVLKDMLDTGRSLGLSGIELLQGIVLLPGEWTPQNSYLTAAQKLNRKKIVDDNKKEIDECYEQS

SEQ ID NO: 19 - DNA, 2010 bp, Saccharomyces cerevisiae
  CDS (1)..(2010): GeneID: 852329 encoding FAT 1 [Protein ID - P38225]
atgtctcccatacaggttgttgtctttgccttgtcaaggattttcctgctattattcagacttatcaagctaattataacccctatccagaaatcactgggttatctatttggtaattattttgatgaattagaccgtaaatatagatacaaggaggattggtatattattccttactttttgaaaagcgtgttttgttatatcattgatgtgagaagacataggtttcaaaactggtacttatttattaaacaggtccaacaaaatggtgaccatttagcgattagttacacccgtcccatggccgaaaagggagaatttcaactcgaaacctttacgtatattgaaacttataacatagtgttgagattgtctcatattttgcattttgattataacgttcaggccggtgactacgtggcaatcgattgtactaataaacctcttttcgtatttttatggctttctttgtggaacattggggctattccagcttttttaaactataatactaaaggcactccgctggttcactccctaaagatttccaatattacgcaggtatttattgaccctgatgccagtaatccgatcagagaatcggaagaagaaatcaaaaacgcacttcctgatgttaaattaaactatcttgaagaacaagacttaatgcatgaacttttaaattcgcaatcaccggaattcttacaacaagacaacgttaggacaccactaggcttgaccgattttaaaccctctatgttaatttatacatctggaaccactggtttgcctaaatccgctattatgtcttggagaaaatcctccgtaggttgtcaagtttttggtcatgttttacatatgactaatgaaagcactgtgttcacagccatgccattgttccattcaactgctgccttattaggtgcgtgcgccattctatctcacggtggttgccttgcgttatcgcataaattttctgccagtacattttggaagcaagtttatttaacaggagccacgcacatccaatatgtcggagaagtctgtagatacctgttacatacgccaatttctaagtatgaaaagatgcataaggtgaaggttgcttatggtaacgggctgagacctgacatctggcaggacttcaggaagaggttcaacatagaagttattggtgaattctatgccgcaactgaagctccttttgctacaactaccttccagaaaggtgactttggaattggcgcatgtaggaactatggtactataattcaatggtttttgtcattccaacaaacattggtaaggatggacccaaatgacgattccgttatatatagaaattccaagggtttctgcgaagtggcccctgttggcgaaccaggagaaatgttaatgagaatctttttccctaaaaaaccagaaacatcttttcaaggttatcttggtaatgccaaggaaacaaagtccaaagttgtgagggatgtcttcagacgtggcgatgcttggtatagatgtggagatttattaaaagcggacgaatatggattatggtatttccttgatagaatgggtgatactttcagatggaaatctgaaaatgtttccactactgaagtagaagatcagttgacggccagtaacaaagaacaatatgcacaagttctagttgttggtattaaagtacctaaatatgaaggtagagctggttttgcagttattaaactaactgacaactctcttgacatcactgcaaagaccaaattattaaatgattccttgagccggttaaatctaccgtcttatgctatgcccctatttgttaaatttgttgatgaaattaaaatgacagataatcataaaattttgaagaaggtttatagagagcaaaaattaccaaagggtttggatggaaatgacactattttttggctcaagaattacaagcgctatgaagtcttgaccgctgctgattgggaagccatcgatgcacaaacaattaaattatga

SEQ ID NO: 20 - protein, 669 aa, Saccharomyces cerevisiae
MSPIQVVVFALSRIFLLLFRLIKLIITPIQKSLGYLFGNYFDELDRKYRYKEDWYIIPYFLKSVFCYIIDVRRHRFQNWYLFIKQVQQNGDHLAISYTRPMAEKGEFQLETFTYIETYNIVLRLSHILHFDYNVQAGDYVAIDCTNKPLFVFLWLSLWNIGAIPAFLNYNTKGTPLVHSLKISNITQVFIDPDASNPIRESEEEIKNALPDVKLNYLEEQDLMHELLNSQSPEFLQQDNVRTPLGLTDFKPSMLIYTSGTTGLPKSAIMSWRKSSVGCQVFGHVLHMTNESTVFTAMPLFHSTAALLGACAILSHGGCLALSHKFSASTFWKQVYLTGATHIQYVGEVCRYLLHTPISKYEKMHKVKVAYGNGLRPDIWQDFRKRFNIEVIGEFYAATEAPFATTTFQKGDFGIGACRNYGTIIQWFLSFQQTLVRMDPNDDSVIYRNSKGFCEVAPVGEPGEMLMRIFFPKKPETSFQGYLGNAKETKSKVVRDVFRRGDAWYRCGDLLKADEYGLWYFLDRMGDTFRWKSENVSTTEVEDQLTASNKEQYAQVLVVGIKVPKYEGRAGFAVIKLTDNSLDITAKTKLLNDSLSRLNLPSYAMPLFVKFVDEIKMTDNHKILKKVYREQKLPKGLDGNDTIFWLKNYKRYEVLTAADWEAIDAQTIKL

SEQ ID NO: 21 - DNA, 2139 bp, Yarrowia lipolytica
  CDS (1)..(2139): Gene ID: 2911572 encoding FAT1 [Protein ID - Q6C5Q8]
atgaaaacgatattgaaaataacaaaatccgagaatcaaaacgcacttttcaaaaatcccatatctcctccacatcccccacaaacccgaacccctagtctcaaaattaaggttcaaccccagataccccatttttttcatgctggcccttatattaaccgtggctgcccttttttaagtccccttctccactatcaccttgtcgaaatcccaaccacaatgacagctggactagttgctgccgccgccattggagccgcctacctggaggccaagacgctcatctccgaagatgcctacatgatccgaggcgccatgaccaacggtctggattttttctacaacgcctggaagggccgagtgcaatactggtacgcgtttgaagacgcggtgaagaagtaccccaacaacccggcaatcgtctaccccaagcccatcgagggcaagaagcccagcggcgactcgtacgacgacctgtttgacgtggagaccttcacctaccagcagctgtacgatgaggtgctgaaaatgtcacacctgctgcgaaacaagtacggagtgaccgccaacgacaccattgccctcaacgccatgaactcgcccctgttcattatcgtgtggttcgccatctggaacctgggcgccaccccggccttcattaactacaacctggccgacaagtcgctgctgcactgcctcaaggtcggacatgcctccatcatgttcgtcgacaccgaggtcgagggcaacgtgcgaccttcgctggccgagatcaagtccgaggccaagtgcgacaccgtgttcatggacgacgacttcctcgctgcctacgccgcctccccggcctacagagcccccgactacgagcgacatcccgagcagaaggactatgacactgccgtgctcatctacacgtccggaaccaccggtctgcccaagcccgccatcatgtcgtggaagaaggccaagctcatgtcgtcgctctacggccactccatccggctcaagaacaacggtgtcgtctactccgccatgcctctctaccactccaccgccgccattctcggctgtctgccctgcctcaaccgaggagccgcttacgcccccggccgaaagttctctaccaccaccttctggacccaggccaagctcaccaacgccactcacatccagtacgtcggagagacctgccgatacctgatcaacgcccctccctctcccgacgagaagagtcaccagatcaaggtggcgttcggcaacggaatgcgacgagatatttgggtcaagttcaaggaacgattcaacatccccgccatcggcgagttttacgccgccaccgagggtcctctcggaaccaacaacttccagcagggtgagattggtatcggtgccatgggccgatacggtaagcttctggctgccatcctggccacccgacagaccatcgttcctgtggatcccgaagacgagactgagctgtggcgagaccccgagaccggcttctgccgagtcgcccagtccgacgagcccggtgagttcatccagaagatccccaaccccgagaaggtgcacgagaccttccagggataccttggtaacgataaggccaccaactccaagattatgcgagacgtgttcaagaagggcgatgcctactaccgaaccggtgatctggtgcgactcaacgacgagcagtgctactactttgtcgaccgtcttggagacaccttccgatggaagtccgagaatgtgtccacctccgaggtggaggagcacgttggcgcttccgaccccaacattgagcaggttgtctgcgtgggtgtcaaggtgcccgagcacgagggccgagctggtttcgccgtggtgaagctcaaggacgcttctgtcaagcccaaccttgaccagattgccgagtactcgctcaagcagctgcccaagtacgccgtgcctctgttcatcaagtttgtcgacgagattgagcgaaccggcaacaacaaggtgcagaaggtcaagtacaagaaccagaagatgccccatgaggaaggcgagagccccatttactggctcaagggcaacaagtacgtggagctcgatgctggagactgggcttctctgggatccggaaagattaagctgtaa

SEQ ID NO: 22 - protein, 712 aa, Yarrowia lipolytica
MKTILKITKSENQNALFKNPISPPHPPQTRTPSLKIKVQPQIPHFFHAGPYINRGCPFLSPLLHYHLVEIPTTMTAGLVAAAAIGAAYLEAKTLISEDAYMIRGAMTNGLDFFYNAWKGRVQYWYAFEDAVKKYPNNPAIVYPKPIEGKKPSGDSYDDLFDVETFTYQQLYDEVLKMSHLLRNKYGVTANDTIALNAMNSPLFIIVWFAIWNLGATPAFINYNLADKSLLHCLKVGHASIMFVDTEVEGNVRPSLAEIKSEAKCDTVFMDDDFLAAYAASPAYRAPDYERHPEQKDYDTAVLIYTSGTTGLPKPAIMSWKKAKLMSSLYGHSIRLKNNGVVYSAMPLYHSTAAILGCLPCLNRGAAYAPGRKFSTTTFWTQAKLTNATHIQYVGETCRYLINAPPSPDEKSHQIKVAFGNGMRRDIWVKFKERFNIPAIGEFYAATEGPLGTNNFQQGEIGIGAMGRYGKLLAAILATRQTIVPVDPEDETELWRDPETGFCRVAQSDEPGEFIQKIPNPEKVHETFQGYLGNDKATNSKIMRDVFKKGDAYYRTGDLVRLNDEQCYYFVDRLGDTFRWKSENVSTSEVEEHVGASDPNIEQVVCVGVKVPEHEGRAGFAVVKLKDASVKPNLDQIAEYSLKQLPKYAVPLFIKFVDEIERTGNNKVQKVKYKNQKMPHEEGESPIYWLKGNKYVELDAGDWASLGSGKIKL

SEQ ID NO: 23 - DNA, 1887 bp, Pichia pastoris
  CDS (1)..(1887): GeneID: 8197297  encoding FAT1 [Protein ID - C4QXD6]
atgatcactgaactcgttgattatttagataccaaatttcgagtcagagaggacatatacattgtgcctacagtattaaagcgatgctttcaccatttatataactgttacaagcatagagtaaacttctggtatcagtttgaagaaacggtgggtcgatacccagataaaaatgctttaattttcccaagaaaaaacaccgctactaatggatttgatttggagatatacacatacaaagaattatatgaggtggttctcaggctaagtcatatcttagtggaggagtatggagtttgtccggacgagattgtagcgatggactacgccaataaacctatgttcattttcctttggtttgcattatggaacataggagccaaaccagcatttttaaattttaacgttacgaagaaccctctcattcattgcctgaaagtcgtcgagtcttcgcacttcttcgttgatgtcgacgttttaccaaccgtgaaggacactttagacgaacttcaagaaaagtcaccatccttgtcaatctcagtgttaaatgaggacacactgatgcaacgattattagacccagaatcactgggttttagacaggcagatcagaggagaaactacatggacaatgattacgatattggagccctgatctatacaagtggaaccacaggccttcctaagtcagctatcatgagctggaggaaagcattcatggcatcctcattttttggccatgttatgaggatcagctcagacagtgtagtttttactgccatgccgttatatcattctacagctgccatgttgggtgtactaccagcatttggtattggaggctgtgtagttcttgctcccaagttttctgtttcctcattttggactcaagcgaaagttactggcgccactcatatccagtacgttggggaagtttgtaggtatttgatgaacagtagtgttcatccagatgaaaagaatcatcatgtgaaagttgcatacggaaatggtttacggagtgatatatggagacagtttaaacaaaggtttaatattgaagctgtgggagagttttatgcagccacggaggctccatttgcaactacgtgttttcaaacaggaaactttggcattggagcttgccgaagttacggcaagttcgtcaactctgtattgcagttccagcattgcattttgaaaattgatcctgaggattcaaccagactctacagagataagacagggcgctgtcacgtagcagattttgatgagcccggggaattagtgatgaaaatattcttcccaaggaatccaaaatctacatttcagggttacctaaacaataagagagaaacagaatcaaaagtcgcacgcaatgtattccacaaaaacgatgcatggtatcgatctggtgatcttttacggatggataaagacggtttattgtacttcatagaccgtcttggagatacttttcgctggaaatcagaaaatgtatctaccactgaggttgaaaacgaagttctacaagtgaaaggagtgaaacaatgttgtgtcgttggggctcaggtgctcaaccacgaagggcgggctgggtattgtgttattgaaaaaatagaaggactaactacagagaaagttctagagtctgttgcacatcatatacagacaacgctgccatcgtacgctagaccagtatttgtcagatttgacaatatcccaatgactgacaatcacaaggtatcaaagaaagatttcaaagaccctcagctgcctagaaacaaatgtgaagaaattgtatattatttgaacgggaagaccaaagagtatcaatctcttactgatgaagtttggtctcaaattcttgacggtaacatcagactctaa

SEQ ID NO: 24 - protein, 628 aa, Pichia pastoris
MITELVDYLDTKFRVREDIYIVPTVLKRCFHHLYNCYKHRVNFWYQFEETVGRYPDKNALIFPRKNTATNGFDLEIYTYKELYEVVLRLSHILVEEYGVCPDEIVAMDYANKPMFIFLWFALWNIGAKPAFLNFNVTKNPLIHCLKVVESSHFFVDVDVLPTVKDTLDELQEKSPSLSISVLNEDTLMQRLLDPESLGFRQADQRRNYMDNDYDIGALIYTSGTTGLPKSAIMSWRKAFMASSFFGHVMRISSDSVVFTAMPLYHSTAAMLGVLPAFGIGGCVVLAPKFSVSSFWTQAKVTGATHIQYVGEVCRYLMNSSVHPDEKNHHVKVAYGNGLRSDIWRQFKQRFNIEAVGEFYAATEAPFATTCFQTGNFGIGACRSYGKFVNSVLQFQHCILKIDPEDSTRLYRDKTGRCHVADFDEPGELVMKIFFPRNPKSTFQGYLNNKRETESKVARNVFHKNDAWYRSGDLLRMDKDGLLYFIDRLGDTFRWKSENVSTTEVENEVLQVKGVKQCCVVGAQVLNHEGRAGYCVIEKIEGLTTEKVLESVAHHIQTTLPSYARPVFVRFDNIPMTDNHKVSKKDFKDPQLPRNKCEEIVYYLNGKTKEYQSLTDEVWSQILDGNIRL

SEQ ID NO: 25 - DNA, 1992 bp, Candida tropicalis
  CDS (1)..(1992): GeneID: 8302036 encoding FAT1 [Protein ID - C5MBJ9]
atgtctgtggagaatgcaaaactacagaggaattcattggctgttctgcttttgaagatctataagtccaacagatcattgttgttgaacacgtcatatattatattaattattgctgctttcacaggggcaactaacaccggtagaggaacatcttcaagaacaactaaactagatgctgttgatgaacaagcacttaaaaagaaacacccaaaactttctagagaatcgtttcaaagattaagaaaagcaattttgccttcgtttttagataaaacaatggtgtactttcttgcgaatttatcattattggtagtaagagcattattgactcttcgggttgcaacacttgatggtcagttggtgggagcgttggtttctagaagattgaaagtgtttgctaaatatttattatattggatgcttcttggtattcctgcttcattgacaaatgccttgttggactggacaaaactgaacttgagtaagagtattagaaccaatttgaataataatatcatggaagaatatttaccagacaacttagatccaaattattactcgttaatacatttgacggataacaagatcaaggacccaaatcaaagaattacgactgatactgctcgtttaagtgatgcattagctagtttaccgggacacatattgaaaccaacgttggatatggttttgtgtgcccagcaattaagtaagagtggtgttggtaatggtgaaggtaccttagcattgggaattttggcccatttttcaacaatgattattcgttttttctcaccaccatttgcaaaattggcagctgaaagagcgaatcttgaagggaaattacgtgcagcacattccaaaattgttgccaataatgaagagattgcatttttaggtggtcatgatcgtgaattggatcacatcgatcattgttattacacattggaacgtttctctaaaggtgaatattggaagagagcaatccatgaaatcacacaaacttttattgtgaaatatttctggggtgttgctggtttggtattatgttcagcacccgtgtttcttacgaaatacttgggtgaaccagaggacaagaacgctgctgggaactttattacaaatagaagattattgatgagtgcttcagattcattagatcgtttaatttattctagaagatatttactacaaattgtgggtcatgccactagagtttctgatttcttggataccttacatggagttgaacaaaggaagaaaagaatcacgtctaatgttcagttggataataatgaaattacctttgatcatgttcgattaatgactccaactgaggtgacattgattgaagatttgaacttttccattaagccaggtgatcatttattaattgttggtccaaatggttctggtaagtcgtcgttgtttagaatgttgggaggattatggccagttagatttggtaccattagaattccaaacactgaaaatatgttctacttgccacaaaaggcatatcttgtggaagggtcgtttagagagcaaatcatttacccacacaacttgtgtcagcaaaagaaaactgatgaagaattaaaggaaattttgaaggttttgaaattggaagattattcactgcagttggatgaagtaaagaaatggaccgaagagttgtcaattggtgcacaacagagattggctatggccagattatattatcatgaacctaaatttgccgttttggatgaatgtacatctgctgtttcaccagatatggaacaacttatgtatcaacatgcacaaggtttgggtattacacttttatcggtcgcccatagacctgcattgtggcatttccataagtatttattggaatttgacggtcaaggtggttattatttcggtacattggatgaaaaacataaaatgaaacttgaagaagaagaaagactcaagaaagagaatgaaaagaaaagcgtcgttaaataa

SEQ ID NO: 26 - protein, 663 aa, Candida tropicalis
MSVENAKLQRNSLAVLLLKIYKSNRSLLLNTSYIILIIAAFTGATNTGRGTSSRTTKLDAVDEQALKKKHPKLSRESFQRLRKAILPSFLDKTMVYFLANLSLLVVRALLTLRVATLDGQLVGALVSRRLKVFAKYLLYWMLLGIPASLTNALLDWTKLNLSKSIRTNLNNNIMEEYLPDNLDPNYYSLIHLTDNKIKDPNQRITTDTARLSDALASLPGHILKPTLDMVLCAQQLSKSGVGNGEGTLALGILAHFSTMIIRFFSPPFAKLAAERANLEGKLRAAHSKIVANNEEIAFLGGHDRELDHIDHCYYTLERFSKGEYWKRAIHEITQTFIVKYFWGVAGLVLCSAPVFLTKYLGEPEDKNAAGNFITNRRLLMSASDSLDRLIYSRRYLLQIVGHATRVSDFLDTLHGVEQRKKRITSNVQLDNNEITFDHVRLMTPTEVTLIEDLNFSIKPGDHLLIVGPNGSGKSSLFRMLGGLWPVRFGTIRIPNTENMFYLPQKAYLVEGSFREQIIYPHNLCQQKKTDEELKEILKVLKLEDYSLQLDEVKKWTEELSIGAQQRLAMARLYYHEPKFAVLDECTSAVSPDMEQLMYQHAQGLGITLLSVAHRPALWHFHKYLLEFDGQGGYYFGTLDEKHKMKLEEEERLKKENEKKSVVK

SEQ ID NO: 27 - DNA, 6702 bp, Saccharomyces cerevisiae
  CDS (1)..(6702): GeneID: 855750 (coordinates 661377 to 654676) encoding ACC1 [Protein ID - Q00955]
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 28 - protein, 2233 aa, Saccharomyces cerevisiae
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 29 - DNA, 6843 bp, Schizosaccharomyces pombe
  CDS (1)..(6843): GeneID: 2543344; (coordinates 1246095 to 1253559) encoding ACC1 [Protein ID - P78820]
atgcgccagagcgttacctcttcctcttcctgtagcaagctctacgcgataaaagcaaccatttcccttccacgactcttttaccgtagactgagaactatggctcctcgtgtagcctcccattttctgggaggcaattccttagataaagcacctgcaggaaaggtgaaagattatattgcatcacacggaggacacactgttatcacgtctattcttattgctaataatggtattgcggccgtgaaagaaatccgaagcattcggaaatgggcttatgaaaccttcaataatgaaagagctatcaagtttactgttatggcaacgccagatgatttaaaagttaatgccgattatattcgtatggccgatcagtatgtcgaagtacctggcggctcaaataacaataattatgctaatgtcgaacttatcgttgacattgctgaacgtatgaacgtccatgctgtttgggctggttggggacacgcatctgaaaaccctaaattgcctgagatgctttctgccagtagtaagaaaatcgtttttattggtcctccaggtagcgcaatgcgtagtcttggtgacaaaattagttctacaatcgttgctcaaagtgctcgtgtaccttgtatgtcttggtccggtaatgaactcgaccaagtacgtattgatgaagagacaaacattgttactgttgacgatgatgtttatcaaaaagcctgtattcgctctgcagaagaaggtattgccgtcgccgagaagattggttatcccgtcatgattaaggcctctgaaggcggtggtggtaaaggtattcgtcaggttacttcaaccgaaaagtttgctcaagcattccaacaagtacttgatgaactccctggatctcccgtttttgttatgaaacttgctggacaagcacgccatttggaagttcaaattttagctgatcaatatggtaataatatttctctttttggtcgtgattgttccgttcaacgccgtcatcaaaaaattattgaggaggctcctgttaccatcgcacctgccgctaccttccatgaaatggagcgtgccgccgtgcgtttaggtgaattggtcggttacgcttctgctggtaccattgagtatctttatgagccagagaatgacaggttctatttccttgaactgaaccctcgtttacaggtcgagcatccaactaccgaaatggtttctggcgttaatttacccgctgcacaacttcaagttgctatgggtttgcctcttagtcgtattccacacattcgtgagctctatggcttaccacgtgatggtgactctgaaatcgattttttctttcaaaatcccgaatcttttaaagtacagaaggtccctactcctaaaggccattgtgttgcctgtcgtattacgtctgaagatcccggcgaaggatttaaaccatcgagcggtatgattaaagatctcaactttcgttcttctagcaatgtgtggggttatttctctgttggtactgctggtggaattcatgagtttgcggattcccaattcggtcatattttttcatttgcagaatctcgtgaatcctctcgcaaatcgatggtggttgcgttaaaagaattatctattcgtggtgattttagaactactgtcgaatatctcgtgcgtctccttgaaactaaggagttttctgaaaatgagtttaccacaggatggctagatcggcttattgcacaaaaagttacatctgctcgtcccgacaagatgcttgctgttgtatgtggtgctcttgtccgtgctcatgctactgccgatactcagtaccgtgctttcaaatcctaccttgaacgcggtcaagtaccgtcccgtgaatttttgaaaaatgtgtatgatattgaatttatttatgataacactcgctatcgttttaccgcatctcgttcttctccaggctcttatcatttgtttttaaatggttctcgttgtactgctggtgtccgttctttgactgatggtggattgttagttttgctaaacggacattcctatacagtatactatcgtgatgaggtaactggtactcgtatatctatcgataacctttcttgtatgctggaacaagaaaatgatcctactcaattaagaactccttcccctggcaagttggttcgtttcttggttgaaacaggtgagcatattaaagccggtgaagcgtatgcagaggtagaagttatgaaaatgattatgcctttagtagcaaccgaagatggtgttgttcaattgataaagcaacccggtgcatctttagacgccggtgatattcttggaatactcacgcttgatgatcctagccgtgtcacccatgcattaccatttgatggtcagcttcctaattggggtgagcctcaaattgcgggaaataagccttgtcaacgctatcatgctcttttgtgtattcttttggacattctaaagggatatgataaccaaatcattctcaacagtacctacaatgaatttgttgaagtccttcgtaatcatgaattgccctatagcgaatggagtgctcattattcagcattggttaatagaatctctcctgtacttgataagctttttgtatctataatcgaaaaagccagatctcgtaaagctgaatttcctgccaaacagcttgaggttgctattcagacttattgtgatggtcaaaatttggcgacgactcaacaattaaaggtccaaattgcacctctccttaaaatcatatctgactacaaagacggcctcaaagttcatgaatacaatgttattaaaggtttgctcgaagaatattataatgttgaaaagttgttctctggaattaataagcgagaagaagatgttattcttcgtctacgtgacgaaaataaagatgatgttgataaagttattgcgttggctttatctcattctcgtataggatctaagaataacttgttaattacaattcttgatctaatgaagtccgaaccatcaacttttgtttctctgtactttaatgacattttgaggaagcttacagatttggattcaagggttacttctaaagtgtctctaaaggctcgtgagttgttaattacatgtgctatgccttctcttaatgagcgattctctcaaatggagcacatattgaaatcgtctgtagttgaaagtcattatggtgatgctaaattctcacaccgtacaccatctttagacattctgaaagaattgattgattctaaatatacagtctttgatgttttacctgctttcttttgtcacaccgacccatgggtatctttagctgctcttgaggtatatgttagacgtgcttatcgtgcctactctgttcttgaaatcaactatcataccgaggccggaactccgtatgtactcacgtggcgttttcagcttcattcaagtggtgctccgggtttgggtgccaactcaactaatggttccaatttccctgcaagcactactccttcatacgaaaacagcaatcgacgcctgcagtctgttagtgatctttcttggtatgtcaataaaacagactctgagccattccgttttggtacaatgattgccgcagaaactttcgatgaattggaaaataaccttgcccttgcaatcgaccgtttaccactttctcgtaattactttaatgctggtttaacgttggatggcaattcttcttcagctaacgataacactcaagaattaactaatgtagtgaacgttgcgttaacctcaactggtgatttggatgattctgctattgttagcaagcttaaccaaatccttagtgatttccgtgatgatttgcttgagcataatgttagaagagtgacaattgttggtggcagaattaacaagtctgcttatccttcctactatacttatcgtgtttccgctgaacaaaaagacggcaatcttgtacactataacgaagatgagcgtattcgtcatattgaacctgcattggcattccaattagaattgggtcgtctatcgaacttcaatattgaacccgttttcaccgataatcataacattcatgtttatcgtgctaccgccaaaaatatggatacagataagcgattctttactcgtgcattagttagaccaggaagattacgtgacgagatacctactgctgagtatcttatatccgaaacccatcgtttaattaatgatattttggatgctttggaagttatcggtcatgaacaaacagacttgaatcatattttcattaactttacaccagcctttggtcttgctcctaagcaagttgaagctgccctcggcggatttttggaacgttttggccgtcgtttatggcgcttgagagtaactgcagctgaaattcgtattatttgcacggacccatcaactaacactttgtttcctcttcgtgtcattatttctaatgtttctggatttgttgtgaacgttgaaatttatgctgaagtcaagactgagaataattcttggatatttaagagtatcggacaacctggatccatgcatcttcgccccatcagtacaccttatcctaccaaagaatggcttcaacctcgtcgttacaaagctcaattaatgggcactactttcgtttatgacttcccagaattattccgtcgcgccttcaccgatagctggaaaaaggttccaaatgggcgatccaaagttactataccccagaatatgtttgaatgtaaggagcttgttgctgacgaacatggtgtattacaggaagtcaatagggagcctggaactaactcctgtggtatggtagcatggtgcattactgttaagacgcctgaatatcctaatggacgaaaaattatcgtagtggctaacgacatcactttccaaattggttcttttgggccccaagaggatgaatacttttataaagttactcaattggcacgtcaacgcggtattcctcgtatttacctcgctgccaattccggtgcacgtattggagttgctgatgaaatcgtccctcttttcaatattgcttgggtcgatcccgatagtccagaaaagggttttgattatatctatcttactccagaggcatatgagcgtcttcagaaagaaaatcccaatattctcaccactgaggaggttgttactgaaactggggaacttcgccataagattaccacaatcattggctcaagcgagggtcttggtgttgaatgtttgcgtggatccggtctgattgctggtgtcacatctcgcgcatacaatgacatttttacatgtactttggtcacttgtcgtgctgttggtattggcgcgtacttggttcgtctcggccaaagagctgtacaaatcgaaggccaaccaattattctaacaggtgcacccgcccttaacaaggttttaggccgtgaggtctatacctccaacttgcaattaggtggtactcaagttatgcatagaaatggtatatcccatcttactagtcaagatgattttgatggcatttcgaaaattgtaaactggatttcctatatccccgataaacgtaacaatccagtaccaatttcaccatcatcagatacatgggatcgtgatgtggagttctatccttctcaaaatggttacgatcctcgttggttaattgccggaaaggaagatgaagattctttcttgtatggtttatttgacaaaggatctttccaggaaactttgaatggctgggccaagactgttgttgttggtcgtgctagaatgggcggaattcctactggtgtgattgctgtcgagactcgtactattgaaaacactgtaccggctgatccagctaaccctgactctactgaacaagtattaatggaggctggtcaagtttggtatcccaactcagccttcaagactgctcaagcaatcaatgacttcaaccatggtgaacagttacctctttttattcttgctaattggcgtggattttctggtggtcaacgtgatatgtttaatgaggtactcaaatatggttcttatatcgtagatgctttggcttcttataaacaacctgtatttgtatacattcctccattcagtgaacttagaggtggctcttgggttgtagtagatccaaccatcaatgaggatcaaatggaaatgtacgcagatgaagagagtagagctggtgttttggaacctgaaggtatggtcagtattaaattcagacgtgaaaagttgctttctttgatgcgacgctgtgatcataaatatgcatcattgtgcaatgagcttaaaagagatgatttgagtgctgatgacctttcaactataaaggtcaagttgatggaacgcgaacagaagcttatgccaatttatcaacaaattagtattcattttgccgacttgcatgatcgtgttggtcgtatggttgcaaagaaggttgtccgtaaaccgttgaaatggacagaagctagacgtttcttttactggcgtctccgcagacgtttgaatgaacattatgctcttcaaaagattacccagctcattccttccttgactatccgtgaatctcgtgagtatctccagaaatggtatgaagagtggtgtggaaagcaagattgggatgaatctgataagtctgttgtttgttggattgaggaacataacgacgatttgagtaagagaactcaggaacttaagagtacttattacagtgagcgtctttctaaactccttcgttcagataggaagggaatgatagacagccttgcacaagttttgaccgagctcgacgaaaatgaaaagaaagaattggccggaaaactcgcgtcggttaattaa

SEQ ID NO: 30 - protein, 2280 aa, Schizosaccharomyces pombe
MRQSVTSSSSCSKLYAIKATISLPRLFYRRLRTMAPRVASHFLGGNSLDKAPAGKVKDYIASHGGHTVITSILIANNGIAAVKEIRSIRKWAYETFNNERAIKFTVMATPDDLKVNADYIRMADQYVEVPGGSNNNNYANVELIVDIAERMNVHAVWAGWGHASENPKLPEMLSASSKKIVFIGPPGSAMRSLGDKISSTIVAQSARVPCMSWSGNELDQVRIDEETNIVTVDDDVYQKACIRSAEEGIAVAEKIGYPVMIKASEGGGGKGIRQVTSTEKFAQAFQQVLDELPGSPVFVMKLAGQARHLEVQILADQYGNNISLFGRDCSVQRRHQKIIEEAPVTIAPAATFHEMERAAVRLGELVGYASAGTIEYLYEPENDRFYFLELNPRLQVEHPTTEMVSGVNLPAAQLQVAMGLPLSRIPHIRELYGLPRDGDSEIDFFFQNPESFKVQKVPTPKGHCVACRITSEDPGEGFKPSSGMIKDLNFRSSSNVWGYFSVGTAGGIHEFADSQFGHIFSFAESRESSRKSMVVALKELSIRGDFRTTVEYLVRLLETKEFSENEFTTGWLDRLIAQKVTSARPDKMLAVVCGALVRAHATADTQYRAFKSYLERGQVPSREFLKNVYDIEFIYDNTRYRFTASRSSPGSYHLFLNGSRCTAGVRSLTDGGLLVLLNGHSYTVYYRDEVTGTRISIDNLSCMLEQENDPTQLRTPSPGKLVRFLVETGEHIKAGEAYAEVEVMKMIMPLVATEDGVVQLIKQPGASLDAGDILGILTLDDPSRVTHALPFDGQLPNWGEPQIAGNKPCQRYHALLCILLDILKGYDNQIILNSTYNEFVEVLRNHELPYSEWSAHYSALVNRISPVLDKLFVSIIEKARSRKAEFPAKQLEVAIQTYCDGQNLATTQQLKVQIAPLLKIISDYKDGLKVHEYNVIKGLLEEYYNVEKLFSGINKREEDVILRLRDENKDDVDKVIALALSHSRIGSKNNLLITILDLMKSEPSTFVSLYFNDILRKLTDLDSRVTSKVSLKARELLITCAMPSLNERFSQMEHILKSSVVESHYGDAKFSHRTPSLDILKELIDSKYTVFDVLPAFFCHTDPWVSLAALEVYVRRAYRAYSVLEINYHTEAGTPYVLTWRFQLHSSGAPGLGANSTNGSNFPASTTPSYENSNRRLQSVSDLSWYVNKTDSEPFRFGTMIAAETFDELENNLALAIDRLPLSRNYFNAGLTLDGNSSSANDNTQELTNVVNVALTSTGDLDDSAIVSKLNQILSDFRDDLLEHNVRRVTIVGGRINKSAYPSYYTYRVSAEQKDGNLVHYNEDERIRHIEPALAFQLELGRLSNFNIEPVFTDNHNIHVYRATAKNMDTDKRFFTRALVRPGRLRDEIPTAEYLISETHRLINDILDALEVIGHEQTDLNHIFINFTPAFGLAPKQVEAALGGFLERFGRRLWRLRVTAAEIRIICTDPSTNTLFPLRVIISNVSGFVVNVEIYAEVKTENNSWIFKSIGQPGSMHLRPISTPYPTKEWLQPRRYKAQLMGTTFVYDFPELFRRAFTDSWKKVPNGRSKVTIPQNMFECKELVADEHGVLQEVNREPGTNSCGMVAWCITVKTPEYPNGRKIIVVANDITFQIGSFGPQEDEYFYKVTQLARQRGIPRIYLAANSGARIGVADEIVPLFNIAWVDPDSPEKGFDYIYLTPEAYERLQKENPNILTTEEVVTETGELRHKITTIIGSSEGLGVECLRGSGLIAGVTSRAYNDIFTCTLVTCRAVGIGAYLVRLGQRAVQIEGQPIILTGAPALNKVLGREVYTSNLQLGGTQVMHRNGISHLTSQDDFDGISKIVNWISYIPDKRNNPVPISPSSDTWDRDVEFYPSQNGYDPRWLIAGKEDEDSFLYGLFDKGSFQETLNGWAKTVVVGRARMGGIPTGVIAVETRTIENTVPADPANPDSTEQVLMEAGQVWYPNSAFKTAQAINDFNHGEQLPLFILANWRGFSGGQRDMFNEVLKYGSYIVDALASYKQPVFVYIPPFSELRGGSWVVVDPTINEDQMEMYADEESRAGVLEPEGMVSIKFRREKLLSLMRRCDHKYASLCNELKRDDLSADDLSTIKVKLMEREQKLMPIYQQISIHFADLHDRVGRMVAKKVVRKPLKWTEARRFFYWRLRRRLNEHYALQKITQLIPSLTIRESREYLQKWYEEWCGKQDWDESDKSVVCWIEEHNDDLSKRTQELKSTYYSERLSKLLRSDRKGMIDSLAQVLTELDENEKKELAGKLASVN

SEQ ID NO: 31 - DNA, 6648 bp, Pichia pastoris
  CDS (1)..(6648): GeneID: 8196923 (coordinates 1853491 to 1860196) encoding ACC1 [Protein ID - C4QXW1]
atgagtagtgttaaccactctctccgtcattcaaagctaccgccgcatttccttggtctcaactcggttgaagtcgctgctccctccaaggtcagagactttgtcagggaccatggtggccactcggtcatcacgagagtgctgatcgcaaacaacggtatagctgccgtgaaagaaattcgttccgtcaggaaatgggcgtatgaaacgtttggtaacgatagagccattcaatttattgttatggctaccccagaggatcttgaagctaatgctgaatatattcgaatggctgaccagtatgtcatggtcccaggaggaactgcaaacaacaactatgcgaacgtcgacctcattgtagaaatagcagaatctactgatgctcatgctgtttgggctggttggggttttgcctccgaaaatccccatttgcctgagcaactggccgcttctcctaagaagattatcttcattggccctccgggctctgccatgcgatctcttggtgacaagatttcctctactattgtcgcacaacatgctaaagtcccatgtattccttggtcaggaactggtgtcgatcaggttataatcgaccccgtaagcaatttggtttccgttgatgaagaaacgtacgccaaaggatgctgttccgatccacaggacggtttggcaaaagccaaggctattggtttccctgtgatgattaaagcttccgaaggtggtggtggtaaaggaattagaaaagttgacagggaggaagattttctttctctttatgatcaagctgctaatgaaattccaggttccccaatttttatcatgaagcttgctggagatgccaggcatttggaagttcaattacttgctgatcaatatggaaccaacatctccctttttggaagagattgttccgttcaaagaagacaccaaaagatcatagaagaggcaccagttaccattgccaaacaagacactttcaggcaaatggaacaagccgctgtcagactgggtcaattggttggatacgtttctgccggtaccgttgagtatctatattcacacgctgaggacaagttctacttcttggaactgaaccctcgtcttcaagttgagcatccaaccacagaaatggccacaggtgtcaatcttccagttgcccagttgctaattgcaatgggtattcctttgaatagaatcagagatatcagggtactttacggacttgaaccaaatggcgctacagaaattgactttgaattcaaaactgaagaaagcttgaagagtcaaagaaaacccattccaaagggtcacactattgcatgtcgtatcacatctgaagatcctggtgaaggttttaagccttctggtggtgctctatatgagctaaatttcagatcttcttctagcgtttggggttacttcagtgtaggaaacaaatcctcaattcattctttcagtgactctcaatttggtcatatattctcgtttggcgaaaaccgtcaaatcgccagaaaaaatatggtcgtcgccttgaaagagctttctattcgtggtgactttagaactacaattgagtacttaataaaactgttggaaacagctgatttcgagaacaacaccatcactactggttggttggacgaactgatctcgaagaagctgactgctgaaagacctgatgaaaccacagcaattttatgtggtgctgaaaaaggtcaaatcccaggcaaagaacttcttcgtactattttcccaattgaatttatttatgaaggaaagaagtacaagtttactgtggttcaggctgcatttgacaaatacaacgtctttgtcaacggatgtatgattactgtaagtgtaacccatttgaaggatggcagtttattggtagcacttgatggtaaatcccattctgtctattacttgcaggaagaagtcggaaatactaggttgtcggtggatggtaaatcttgcattttagaagttgagcatgagccaactgaacttcgtactccatctccaggtaaacttatcaaatatcttgtggaacacggtgatcacgtcaaaattggacaaccttacgctgaagttgaagtaatgaagatgtgtatgcctttggtcagtcaggagaatggaactatcaggttattgaagcagccaggatcttcggttgccgctggagacatccttgctattcttgcattggatgatcccagcaaggtgaagcatgctttgccattcgatggtacaatccctgatatgaaacagccatttatccatagcaacaaaccagtttataagttcatttctcttctctccgtgctgaaaaacattttagcagggtatgataatcaagttgtgatgaacgatactctgcagagtctattggatgtgttgaagaaccctgaacttccttattcggaatggaatcattcgatatctgcacttcattcaaggttaccaattcatttggacgaacaattgaccagtttgattgagagatcgcatcaacgtggtgcagactttccagctaagcacttgctcaagcttttggacaaggagcaggctgttaatcctgatccacttttctcccaggtcattgcgcctcttactgctgttgccaaaagctacgaacatggacttgaagttcatgaacacaatgtattcgccgatttgatcacccaatactacgacatagagagcttgtttgccgataaaagggaggaagatgttattttacagctacgtgatgagaacaaatcgtcccttgacaaggtcatcgatgtcgtcttgtcacattccagagttggagctaagaaccatttaatcagagctattctggaaatttatcaaactatctgccaaaatgatctccaagctgcaaccattttgaagaaacctttgaaaaagattgttgagctagattctagatttacagcaaaggtttcgttaaaagctagagagattttgattcaatgttcccttccctctatcaaagaacgttcagaccagctcgagcatatccttcgatcttcagttgtacaaactcagtacggagagagcttcaatggaaactacaaactgcctaacttggacgttatacaagacgtaattgattccaagtacattgtattcgatgttttgacacaatttgttgttagcccaaacaagtatatatttgcagcagcagccgaggtgtatctgcgaagagcttacagggcttactcggtgagagaagttaaacatcatttcgtaggtgattctgctctcccaattgtggaatggaagttccaattgccgctgttatcaacagctgcttacaattccgtgcctgaagctatgagaaactcctccagtaaccgatcctctatttcaatggatagagcagtttctgtctccgatttgaccttcatgatcaacaagaatgattctcaacctttgagaacaggtatcataattcccacaaaccacttagatgacattgaggagtccttgtcatctgccattgatgtcttccctaaacgtccacgtaacaatggaccagctcctgacagaactaatgtggctcctgagcaacctactaacgtatgcaatgttttcattgccaatgtttctggctacaacagtgaggctgagatcgttgacaagattagcagcgttctttctgagttgaaagacgacctcagggctagtggcgttcgaagagttacctttgtcttgggagacaaggttggaacttatccaaaatactataccttcaaatttccagactattttgaagacgagacaatccgtcacatagagcctgctcttgcgttccagctggaactaagaagattgtccaatttcaatattaaacctgttccaactgagaatagaaatattcatgtgtatgaggcagttgccaaaaatacttcatgcattgacaggagattttttactaggggtatcatcagaacaagcagaatcagagaggatgtgactatctctgaataccttatcagcgaagctaatcgtcttatgagtgacattttggacgctcttgagattattgatacctccaacactgatttgaaccatatattcatcaatttctctgctgttttcaatgtcacgccagatgacgttgaagcagcgttcggtggtttcttagaaaggtttggacgtaggctgtggagactacgtgtttctgctgctgaaatccgtattatgtgcacggaccctgagactggtatcccattcccacttcgtgctttaattaacaacgtttcaggatacgttgtgaaatctgaaatgtatcaagaggtgaaaaatgatcatggggaatgggttttcaaaagtcttggtcctacaccaggttcaatgcaccttagaccaatttcaacaccatacccaaccaaagaatggcttcaaccaaaacgttacaaagctcatcttatgggtactacttacgtgtatgatttccctgaattattccgtcaagctacgctctcccaatggaaaaaatactctcctactgcgagagttccttctgatgtgtttgtggccaatgaattgatcgtcgatgattcaggtgaactaactgaagtaagcagagaacccggcgccaacgttgtgggtatggtggccttcaaggtaaccgcaaaaactcctgagtatccacgcggtcgccatttcatcataattgctaatgatatcaccttcaagatcggatcctttggccctcaagaagatgaatatttcaacaaggccacacaacttgcaagaaaattgggcattcctcgaatttatctgtcagccaactcgggtgctagaattggagttgctgaagaacttcttccattattcaaagtagcctggaaggaagaaggtaaaccaagcaagggatttgaatacttatacctcacatcggaagatcttactctattggaaaagtccggaaagtctaacagcgttaccactcaaagaatagttgaagaaggcgaagaacgccacgttataactgccatcattggagctagtgatggactgggtgttgaatgtctaagaggttccggtttgatcgctggtgctacatctcgggcgtacaaggacatcttcactatcacattggtcacctgtagatctgttggtattggtgcttacttggtcagattgggtcaacgagccattcaaattgaaggacaaccaataattttgactggtgcccctgctattaataagttgttgggtagggaagtgtactcttccaacctgcaacttggtggtacccagattatgtacaagaacggtgtttcacacttaaccgccaatgatgatctcgcaggtgtcgaaaagattatggattggttagcttatgtgcctgctaagagaaacatgcctgttcctattttagaatcacttcatgacaaatgggacagagatgtggactataagcctacaagaaatgagccgtacgacgtcagatggatgatcagtggacgtgaaactcctgatggtgagttcgaatctggattgtttgactctgggtccttcactgaaactttgagtggatgggctaaaggtgtagtcgtcggaagagcccgtttaggtggtattcctatgggagtcattggtgttgaaactagagtcacagaaaacctgattccagctgatcccgccaatccagactcaaccgaaatgatgattcaagaagctggtcaagtctggtaccctaacagtgccttcaagactgcacaagctatcaacgatttcaacaatggtgaacagctacccttgatgattttggccaactggagaggtttctctggtggtcaaagagacatgtacaatgaagttttgaaatacggttctttcattgtggatgctttagtcgacttcaagcagcctatcttcacttacattcctcccactgctgagttgagaggtggatcttgggttgttgtagaccctaccatcaatgaagacatgatggaaatgtatgcagacgtcgaatcaagagcaggtgttttggaaccagaaggtatggtaggtatcaaataccgtaaggacaaactccttgctactatggaacgattggatgccaaatatgctgagcttaaatccaaggttagcgatactagtctttcagaaaaggatgtttccgagatcaagaaacaaattgagcagagagagaagcaattgttgccaatttatgcacaaatctctattcaatttgctgatcttcatgacagatctggtcgtatgttggccaagggtgtcattaaaaaggaactggaatgggttaattctcgtcgtttcttcttctggagagtccgtcgtcgtttgaacgaggaatacctcattaagcgtattaccgaattcctatctgcttctgctaccagattggacaagatctcgaggatcaattcttggttgccaacatcgattgatttggaagatgaccagaaggttgccatttggttggaagaaaaccgtaaagctcttgacgccaatatcaaggagctcagggctgagcatgttagaagaactctggctactcttgtcagaactgatatggatactacttccaagagtttggctgaattgatcaaccttcttcctgaaaccgaaaaggaatcaattttatctaagatcaagtcatag

SEQ ID NO: 32 - protein, 2215 aa, Pichia pastoris
MSSVNHSLRHSKLPPHFLGLNSVEVAAPSKVRDFVRDHGGHSVITRVLIANNGIAAVKEIRSVRKWAYETFGNDRAIQFIVMATPEDLEANAEYIRMADQYVMVPGGTANNNYANVDLIVEIAESTDAHAVWAGWGFASENPHLPEQLAASPKKIIFIGPPGSAMRSLGDKISSTIVAQHAKVPCIPWSGTGVDQVIIDPVSNLVSVDEETYAKGCCSDPQDGLAKAKAIGFPVMIKASEGGGGKGIRKVDREEDFLSLYDQAANEIPGSPIFIMKLAGDARHLEVQLLADQYGTNISLFGRDCSVQRRHQKIIEEAPVTIAKQDTFRQMEQAAVRLGQLVGYVSAGTVEYLYSHAEDKFYFLELNPRLQVEHPTTEMATGVNLPVAQLLIAMGIPLNRIRDIRVLYGLEPNGATEIDFEFKTEESLKSQRKPIPKGHTIACRITSEDPGEGFKPSGGALYELNFRSSSSVWGYFSVGNKSSIHSFSDSQFGHIFSFGENRQIARKNMVVALKELSIRGDFRTTIEYLIKLLETADFENNTITTGWLDELISKKLTAERPDETTAILCGAEKGQIPGKELLRTIFPIEFIYEGKKYKFTVVQAAFDKYNVFVNGCMITVSVTHLKDGSLLVALDGKSHSVYYLQEEVGNTRLSVDGKSCILEVEHEPTELRTPSPGKLIKYLVEHGDHVKIGQPYAEVEVMKMCMPLVSQENGTIRLLKQPGSSVAAGDILAILALDDPSKVKHALPFDGTIPDMKQPFIHSNKPVYKFISLLSVLKNILAGYDNQVVMNDTLQSLLDVLKNPELPYSEWNHSISALHSRLPIHLDEQLTSLIERSHQRGADFPAKHLLKLLDKEQAVNPDPLFSQVIAPLTAVAKSYEHGLEVHEHNVFADLITQYYDIESLFADKREEDVILQLRDENKSSLDKVIDVVLSHSRVGAKNHLIRAILEIYQTICQNDLQAATILKKPLKKIVELDSRFTAKVSLKAREILIQCSLPSIKERSDQLEHILRSSVVQTQYGESFNGNYKLPNLDVIQDVIDSKYIVFDVLTQFVVSPNKYIFAAAAEVYLRRAYRAYSVREVKHHFVGDSALPIVEWKFQLPLLSTAAYNSVPEAMRNSSSNRSSISMDRAVSVSDLTFMINKNDSQPLRTGIIIPTNHLDDIEESLSSAIDVFPKRPRNNGPAPDRTNVAPEQPTNVCNVFIANVSGYNSEAEIVDKISSVLSELKDDLRASGVRRVTFVLGDKVGTYPKYYTFKFPDYFEDETIRHIEPALAFQLELRRLSNFNIKPVPTENRNIHVYEAVAKNTSCIDRRFFTRGIIRTSRIREDVTISEYLISEANRLMSDILDALEIIDTSNTDLNHIFINFSAVFNVTPDDVEAAFGGFLERFGRRLWRLRVSAAEIRIMCTDPETGIPFPLRALINNVSGYVVKSEMYQEVKNDHGEWVFKSLGPTPGSMHLRPISTPYPTKEWLQPKRYKAHLMGTTYVYDFPELFRQATLSQWKKYSPTARVPSDVFVANELIVDDSGELTEVSREPGANVVGMVAFKVTAKTPEYPRGRHFIIIANDITFKIGSFGPQEDEYFNKATQLARKLGIPRIYLSANSGARIGVAEELLPLFKVAWKEEGKPSKGFEYLYLTSEDLTLLEKSGKSNSVTTQRIVEEGEERHVITAIIGASDGLGVECLRGSGLIAGATSRAYKDIFTITLVTCRSVGIGAYLVRLGQRAIQIEGQPIILTGAPAINKLLGREVYSSNLQLGGTQIMYKNGVSHLTANDDLAGVEKIMDWLAYVPAKRNMPVPILESLHDKWDRDVDYKPTRNEPYDVRWMISGRETPDGEFESGLFDSGSFTETLSGWAKGVVVGRARLGGIPMGVIGVETRVTENLIPADPANPDSTEMMIQEAGQVWYPNSAFKTAQAINDFNNGEQLPLMILANWRGFSGGQRDMYNEVLKYGSFIVDALVDFKQPIFTYIPPTAELRGGSWVVVDPTINEDMMEMYADVESRAGVLEPEGMVGIKYRKDKLLATMERLDAKYAELKSKVSDTSLSEKDVSEIKKQIEQREKQLLPIYAQISIQFADLHDRSGRMLAKGVIKKELEWVNSRRFFFWRVRRRLNEEYLIKRITEFLSASATRLDKISRINSWLPTSIDLEDDQKVAIWLEENRKALDANIKELRAEHVRRTLATLVRTDMDTTSKSLAELINLLPETEKESILSKIKS

SEQ ID NO: 33 - DNA, 6825 bp, Candida tropicalis
  CDS (1)..(6825): GeneID: 8301221 (coordinates 22944249 to 2301073) enclding ACC1 [Protein ID - C5M4L7]
atgagatgcaaagtatctcaaccagcacaacttactaacttacttgtacatagactcccacgattactttttaaatatcctgttgtaaataccttatttattcccagacgtcattattcctttaatttttcatttaaaaatatactaaagaaaatgacagacctttccccaagtccaacagattcctttaattatacagaattacattcagctttaccagcacattttttgggtggtaattccgtgcttaatgcagaaccttccccagtgacagattttgtcaaatcacaccaaggtcacactgttatcacaaaagtcttgattgcaaataatggtattggtgccgtcaaagaaataagatccgtgagaaaatgggcctatgaaactttcggtgacgaaagagctattcaatttgttgccatggccaccccagaagatatggaagctaatgccgaatatattcgaatggctgatcaatttgttgaagtcccaggtggtactaacaacaataactatgctaatgtcgacttgattgttgaaatcgctgaaagaaccgatgtccatgctgtttgggctggttggggtcatgcctctgaaaatccattgttgccagaaaaattggctgcatctccaaagaaaattgtctttattggtccaccaggatctgccatgagatctttgggtgataaaatctcctcaactatcgttgcacaacacgccaaagtcccatgtattccatggtccggtactggcgttgaagaagttcaaattgatccagctacaaaattagtatcagttagtgacgatgtctacgccaaaggttgttgtacatccccagaagacggtttagagaaagctaagaagattggtttcccagtaatggttaaagcctctgaaggtggtggtggtaaaggtatcagaaaagtcgataacgaaaaggattttatcagtttatataaccaggctgccaatgaaatcccaggttctccaattttcatcatgaaattggctggtgatgctagacatttggaagtccaattatttgccgatcaatatggtaccaacatttctttatttggaagagattgttctgttcaaagaagacatcaaaagattatcgaagaagccccagtcaccattgccaataaggaaactttcactgaaatggaaaaagcagctgttagattgggtaaattggttggttatgtatctgccggtactgttgaatacctttattcttatgctgaagacaaattctactttttggaattgaacccaagattgcaagttgaacatccaactaccgaaatggtttccggtgtcaatttaccagccgctcaattacaaattgctatgggtcttccaatgcacagaatcagagatattagattattgtatggtgttgatccacattctgccactgagattgattttgaattcaagtctccaaactcattaatcactcaaagaaagccagctccaaagggtcactgtactgcttgtcgtatcacttctgaagatcctggtgaaggtttcaaaccaagtggtggtactcttcatgagttaaatttccgttcatcttcaaatgtttggggttacttctcggttgccaaccaatcctctatccattcttttgctgattcccaattcggtcatattttcgcctttggtgaaaatcgtcaagcttccagaaaacacatgattgttgccttgaaagaattgagtattagaggtgatttcagaaccacagttgaatatttgatcaaattgttagagaccccagattttgctgataatactatcactactggttggttggatgaattgatcaccaagaaattaactgctgaaagacctgatcctatcgttgctgttgtttgtggtgccgtcaccaaagctcacattcaagccgaagaagacaagaaggaatatattgaatctttagaaaagggtcaagttccaaacaaatccttgttgagaactattttcccagttgaattcatttatgaaggtgaaagatacaaattcactgccactaaatcttctgaagacaaatacactttgttccttaatggttccagatgtgttattggtgctcgtccattatctgatggtggtttgttgtgtgccttggatggtaaatcacattccatttactggaaggaagaagcggctgccactagattgtcagttgatggtaaaacctgtttgttggaagttgaaaatgatccaactcaattgagaactccatctccaggtaaattggttaaatacttggttgaaagtggtgaacatgtcgatgctgggcaatcttatgccgaagttgaagtcatgaagatgtgtatgccattgattgctcaagaaaatggtgtggttcaattacttaaacagccaggttccactcttaatgctggtgatatcttagccatcttagccttggatgacccatctaaagttaaacatgctaagccttatgaaggtaccttgccatctatgggtgatgcaactgtcactggttccaaaccagctcatttattccaacattatgatactattttgaagaacatcttggctggttatgataaccaagtcattttgaattctactttgaagaatatgatggatatcttgaagaacaaggatttgccatactccgaatggagattacaaatttctgctttgcactccagaatcccacaaaaattagacgaaggtttgaattccttgattgaaagaaccgaaagcagaggtgctgaattcccagctcgtcatgctttgaaacttatcaacaagactcttgccgaaccaggcaacgaattattgaaagatgttgttgctccacttgtttccattgctgatcgttaccaaaacggtttggttgaacatgaatacgattactttgcttcattgatcaacgagtactgtgaagttgaaagcttgttcagtggtgaaaatgtcagagaagaagatgtcattttgaaattgagagatgaaaataaatctgatttgaagaaagttatcagcatttgtttatcccattctcgtgtcagtgctaagaataatttagttttggcaattttggatgcatatgaaccattgttacaatcaaattcctccactgctgttgccatcagagattctttgaagaagattgttcaattagactctcgtgcttgtgccaaggttggtttgaaagctagagaacttttgatccaatgttctttaccatcaatcaaggaaagatccgatcaattggaacacattttgagaagtgctgttgttgaaacttcttatggtgaagtttatgccaaacacagagaaccaaaattggaaattattcaagaagttgttgattccaaacatgttgtctttgatgttttgtctcaatttttggttcaccaagattcatgggtcgccattgctgctgctgaagtttacgttagacgttcttacagagcttatgatttaggtaaaattgattaccatatccatgacagattgccaattgttgaatggaagttcaagttagcacaaattgctggttctagatacaacgccatccaaccagccagtagtggtgatgattcaactactatgaaacatgctgcttctgtttctgacttgtcttttgttgttgactccaagagtgaatccactgccagaaccggtgtcttggttccagctagacatttggatgatgttgatgaaattctttctgctgctttggaatatttccaaccatctgatgccctttctttccaagctaaaggtgatagaccagatttattgaatgttttgaacattgttgtcaccaatgttgatggttattctgacgaagatgaatgtttgaagagaatccatgaaattttggaagaataccaagatgacttggttttcgcaggtgttcgtcgtgtcacttttgtctttgctcatcaaatcggttcttatcctaaatactacacttttagtggaccagattacgaagaaaacaaggttattagacacattgaaccagcattggcattccaattggaattaggaagattggccaactttgatatcaaaccaatcttcaccaacaacagaaacattcatgtttatgaagctattggtaagaatgctccttcagataagagattcttcactagaggtatcattagaggtggtgtccttaaggatgaaatcagtatttctgaatatttgattgctgaatctaacagattgatcagtgatattttggatactttggaagttattgacacctccaattctgatttgaatcatattttcattaacttttctaatgtcttcaatgtccaaccatctgatgttgaagctgcttttgcttcattcttggaaagatttggtagaagattgtggagattgagagttaccagtgctgaaattagaattgtctgtactgatccacaaggtacttcattcccattgcgtgccattatcagtaatgtttccggttatgttgtcaaatctgaattgtacttggaagttaagaatcctaaaggtgattgggttttcaaatctattggtcaaccaggttctatgcacttgcaaccaatttctaccccatacccagttaaggaatctttgcaaccaaaacgttacagagctcacaacatgggaactacttttgtttacgatttcccagaattgttccgtcaagctactatttcccaatggaagaagtatggtaaaaaggctccaaaggatgtctttacttccttggaattgatcactgatgaaaacggtgctttggttgcagttgaaagagatccaggtgccaacaagattggtatggttggtttcaaagttactgctaagactcctgaatacccacgtggccgttctttcatcattgttgccaatgatatcacccacaagattggttctttcggtccagatgaagatgagtatttcaacaaatgtactgaattagccagaaaattgggagttccgagaatttacctttctgctaactccggtgcaagaattggtgttgccgaagaattgattccattataccaagttgcttggaatgaagaaggttgtccagataaaggtttcagatacttgtacttgactcctgaagccagagaagccttggacaaagatggtaaaggtgatactgttgtcactgaacgtatcgttgaagaaggtcaagaacgtcatgttatcaaagccatcattggtgctgaaaatggtttgggtgttgaatgtttgaaaggttctggtttgattgctggtgccacctccagagcttacaaagatattttcactattactttggtcacttgtagatctgttggtattggtgcttatttggtcagattgggtcaaagagctattcaaattgaaggtcaaccaattattttgactggtgctccagccattaacaaattattgggtagagaagtttactcctctaacttgcaattgggtggtactcaaattatgtataacaatggtgtttcccatttgactgccagtgatgatttggctggtgttgaaaagattatggaatggttatcttttgttccagctaagcgtggtatgccagttccaatcttggaatctgaagatacttgggacagagatatcgattactacccaccaaagcaagaagcctttgatgtcagatggatgattgaaggtaaacaagttgaaggtgaagaattcgaatctggtttgtttgataaaggatcattccaagaaaccttgtctggatgggctaaaggtgtcgttgttggtagagctcgtcttggtggtatccctattggtgttattggtgttgaaactagaactattgaaaacatgattccagctgatccagctaacccaagctccactgaagctttgatccaagaagctggtcaagtttggtatccaaattctgcattcaagactgcacaagctattaatgatttcaacaatggtgaacaattacctttgatgatcttggccaactggagaggtttctctggtggtcaaagagatatgtacaatgaagtcttgaaatatggttcttttattgttgatgccttggttgatttcaagcaaccaattttcacttacattccaccaaatggtgaattgagaggtggttcttgggttgttgttgatccaaccattaacgctgatatgatggaaatgtatgctgatgttgattccagagctggtgttttagaaccagaaggtatggttggtattaaatacagacgtgataaattgttggctaccatgcaaagattggatcctacctatgctgaattgaaggaaaaattgaacgattctaaattgtcaccagaagaacatgctgaaatcagtagcaagattgttaaacgtgaaaaggctttgttaccaatttatgctcaaatttctgttcaatttgctgacttgcatgacagatcaggacgtatgttggctaaaggtgttatcagacgtgaaattaaatgggtcgatgctagacgtttcttcttctggagattgagaagaagattgaatgaagaatatgttttgaaattgattggtgaacaactcaagaatgctaataagttagaaaaagttgctagattaaagagttggatgccaactgtcgattacgatgatgaccaagccgttagtacttggattgaagaaagccatgctaaattacaaaagagaatcgaagaattgaaactcgaaagtaagaaatctaacattattaaattgttacaagaagatccatcaaatgctgcttctgttatgaaagaattcattgatagattatctgatgaagaaaaggaaaaattccttaaaaatttgaattaa

SEQ ID NO: 34 - protein, 2274 aa, Candida tropicalis
MRCKVSQPAQLTNLLVHRLPRLLFKYPVVNTLFIPRRHYSFNFSFKNILKKMTDLSPSPTDSFNYTELHSALPAHFLGGNSVLNAEPSPVTDFVKSHQGHTVITKVLIANNGIGAVKEIRSVRKWAYETFGDERAIQFVAMATPEDMEANAEYIRMADQFVEVPGGTNNNNYANVDLIVEIAERTDVHAVWAGWGHASENPLLPEKLAASPKKIVFIGPPGSAMRSLGDKISSTIVAQHAKVPCIPWSGTGVEEVQIDPATKLVSVSDDVYAKGCCTSPEDGLEKAKKIGFPVMVKASEGGGGKGIRKVDNEKDFISLYNQAANEIPGSPIFIMKLAGDARHLEVQLFADQYGTNISLFGRDCSVQRRHQKIIEEAPVTIANKETFTEMEKAAVRLGKLVGYVSAGTVEYLYSYAEDKFYFLELNPRLQVEHPTTEMVSGVNLPAAQLQIAMGLPMHRIRDIRLLYGVDPHSATEIDFEFKSPNSLITQRKPAPKGHCTACRITSEDPGEGFKPSGGTLHELNFRSSSNVWGYFSVANQSSIHSFADSQFGHIFAFGENRQASRKHMIVALKELSIRGDFRTTVEYLIKLLETPDFADNTITTGWLDELITKKLTAERPDPIVAVVCGAVTKAHIQAEEDKKEYIESLEKGQVPNKSLLRTIFPVEFIYEGERYKFTATKSSEDKYTLFLNGSRCVIGARPLSDGGLLCALDGKSHSIYWKEEAAATRLSVDGKTCLLEVENDPTQLRTPSPGKLVKYLVESGEHVDAGQSYAEVEVMKMCMPLIAQENGVVQLLKQPGSTLNAGDILAILALDDPSKVKHAKPYEGTLPSMGDATVTGSKPAHLFQHYDTILKNILAGYDNQVILNSTLKNMMDILKNKDLPYSEWRLQISALHSRIPQKLDEGLNSLIERTESRGAEFPARHALKLINKTLAEPGNELLKDVVAPLVSIADRYQNGLVEHEYDYFASLINEYCEVESLFSGENVREEDVILKLRDENKSDLKKVISICLSHSRVSAKNNLVLAILDAYEPLLQSNSSTAVAIRDSLKKIVQLDSRACAKVGLKARELLIQCSLPSIKERSDQLEHILRSAVVETSYGEVYAKHREPKLEIIQEVVDSKHVVFDVLSQFLVHQDSWVAIAAAEVYVRRSYRAYDLGKIDYHIHDRLPIVEWKFKLAQIAGSRYNAIQPASSGDDSTTMKHAASVSDLSFVVDSKSESTARTGVLVPARHLDDVDEILSAALEYFQPSDALSFQAKGDRPDLLNVLNIVVTNVDGYSDEDECLKRIHEILEEYQDDLVFAGVRRVTFVFAHQIGSYPKYYTFSGPDYEENKVIRHIEPALAFQLELGRLANFDIKPIFTNNRNIHVYEAIGKNAPSDKRFFTRGIIRGGVLKDEISISEYLIAESNRLISDILDTLEVIDTSNSDLNHIFINFSNVFNVQPSDVEAAFASFLERFGRRLWRLRVTSAEIRIVCTDPQGTSFPLRAIISNVSGYVVKSELYLEVKNPKGDWVFKSIGQPGSMHLQPISTPYPVKESLQPKRYRAHNMGTTFVYDFPELFRQATISQWKKYGKKAPKDVFTSLELITDENGALVAVERDPGANKIGMVGFKVTAKTPEYPRGRSFIIVANDITHKIGSFGPDEDEYFNKCTELARKLGVPRIYLSANSGARIGVAEELIPLYQVAWNEEGCPDKGFRYLYLTPEAREALDKDGKGDTVVTERIVEEGQERHVIKAIIGAENGLGVECLKGSGLIAGATSRAYKDIFTITLVTCRSVGIGAYLVRLGQRAIQIEGQPIILTGAPAINKLLGREVYSSNLQLGGTQIMYNNGVSHLTASDDLAGVEKIMEWLSFVPAKRGMPVPILESEDTWDRDIDYYPPKQEAFDVRWMIEGKQVEGEEFESGLFDKGSFQETLSGWAKGVVVGRARLGGIPIGVIGVETRTIENMIPADPANPSSTEALIQEAGQVWYPNSAFKTAQAINDFNNGEQLPLMILANWRGFSGGQRDMYNEVLKYGSFIVDALVDFKQPIFTYIPPNGELRGGSWVVVDPTINADMMEMYADVDSRAGVLEPEGMVGIKYRRDKLLATMQRLDPTYAELKEKLNDSKLSPEEHAEISSKIVKREKALLPIYAQISVQFADLHDRSGRMLAKGVIRREIKWVDARRFFFWRLRRRLNEEYVLKLIGEQLKNANKLEKVARLKSWMPTVDYDDDQAVSTWIEESHAKLQKRIEELKLESKKSNIIKLLQEDPSNAASVMKEFIDRLSDEEKEKFLKNLN

SEQ ID NO: 35 - DNA, 6801 bp, Yarrowia lipolytica
  CDS (1)..(6801): GeneID: 2909424; (coordinates 1578157 to 1585246) encoding ACC1 - [Protein ID - Q6CC91]
atgcgactgcaattgaggacactaacacgtcggtttttcagtatggcttcaggatcttcaacgccagatgtggctcccttggtggaccccaacattcacaaaggtctcgcctctcatttctttggactcaattctgtccacacagccaagccctcaaaagtcaaggagtttgtggcttctcacggaggtcatacagttatcaacaaggtcctcatcgctaacaacggtattgccgcagtaaaggagatccgttcagtacgaaaatgggcctacgagacctttggcgacgagcgagcaatctcgttcaccgtcatggccacccccgaagatctcgctgccaacgccgactacattagaatggccgatcagtacgtcgaggtgcccggaggaaccaacaacaacaactacgccaacgtcgagctgattgtcgacgtggctgagcgattcggcgtcgatgccgtgtgggccggatggggccatgccagtgaaaatcccctgctccccgagtcgctagcggcctctccccgcaagattgtcttcatcggccctcccggagctgccatgagatctctgggagacaaaatttcttctaccattgtggcccagcacgcaaaggtcccgtgtatcccgtggtctggaaccggagtggacgaggttgtggttgacaagagcaccaacctcgtgtccgtgtccgaggaggtgtacaccaagggctgcaccaccggtcccaagcagggtctggagaaggctaagcagattggattccccgtgatgatcaaggcttccgagggaggaggaggaaagggtattcgaaaggttgagcgagaggaggacttcgaggctgcttaccaccaggtcgagggagagatccccggctcgcccatcttcattatgcagcttgcaggcaatgcccggcatttggaggtgcagcttctggctgatcagtacggcaacaatatttcactgtttggtcgagattgttcggttcagcgacggcatcaaaagattattgaggaggctcctgtgactgtggctggccagcagaccttcactgccatggagaaggctgccgtgcgactcggtaagcttgtcggatatgtctctgcaggtaccgttgaatatctgtattcccatgaggacgacaagttctacttcttggagctgaatcctcgtcttcaggtcgaacatcctaccaccgagatggtcaccggtgtcaacctgcccgctgcccagcttcagatcgccatgggtatccccctcgatcgaatcaaggacattcgtctcttttacggtgttaaccctcacaccaccactccaattgatttcgacttctcgggcgaggatgctgataagacacagcgacgtcccgtcccccgaggtcacaccactgcttgccgaatcacatccgaggaccctggagagggtttcaagccctccggaggtactatgcacgagctcaacttccgatcctcgtccaacgtgtggggttacttctccgttggtaaccagggaggtatccattcgttctcggattcgcagtttggtcacatcttcgccttcggtgagaaccgaagtgcgtctcgaaagcacatggttgttgctttgaaggaactatctattcgaggtgacttccgaaccaccgtcgagtacctcatcaagctgctggagacaccggacttcgaggacaacaccatcaccaccggctggctggatgagcttatctccaacaagctgactgccgagcgacccgactcgttcctcgctgttgtttgtggtgctgctaccaaggcccatcgagcttccgaggactctattgccacctacatggcttcgctagagaagggccaggtccctgctcgagacattctcaagacccttttccccgttgacttcatctacgagggccagcggtacaagttcaccgccacccggtcgtctgaggactcttacacgctgttcatcaacggttctcgatgcgacattggagttagacctctttctgacggtggtattctgtgtcttgtaggtgggagatcccacaatgtctactggaaggaggaggttggagccacgcgactgtctgttgactccaagacctgccttctcgaggtggagaacgaccccactcagcttcgatctccctctcccggtaagctggttaagttcctggtcgagaacggcgaccacgtgcgagccaaccagccctatgccgagattgaggtcatgaagatgtacatgactctcactgctcaggaggacggtattgtccagctgatgaagcagcccggttccaccatcgaggctggcgacatcctcggtatcttggcccttgatgatccttccaaggtcaagcatgccaagccctttgagggccagcttcccgagcttggaccccccactctcagcggtaacaagcctcatcagcgatacgagcactgccagaacgtgctccataacattctgcttggtttcgataaccaggtggtgatgaagtccactcttcaggagatggttggtctgctccgaaaccctgagcttccttatctccagtgggctcatcaggtgtcttctctgcacacccgaatgagcgccaagctggatgctactcttgctggtctcattgacaaggccaagcagcgaggtggcgagtttcctgccaagcagcttctgcgagcccttgagaaggaggcgagctctggcgaggtcgatgcgctcttccagcaaactcttgctcctctgtttgaccttgctcgagagtaccaggacggtcttgctatccacgagcttcaggttgctgcaggccttctgcaggcctactacgactctgaggcccggttctgcggacccaacgtacgtgacgaggatgtcattctcaagcttcgagaggagaaccgagattctcttcgaaaggttgtgatggcccagctgtctcattctcgagtcggagccaagaacaaccttgtgctggcccttctcgatgaatacaaggtggccgaccaggctggcaccgactctcctgcctccaacgtgcacgttgcaaagtacttgcgacctgtgctgcgaaagattgtggagctggaatctcgagcttctgccaaggtatctctgaaagcccgagagattctcatccagtgcgctctgccctctctaaaggagcgaactgaccagcttgagcacattctgcgatcttctgtcgtcgagtctcgatacggagaggttggtctggagcaccgaactccccgagccgatattctcaaggaggttgtcgactccaagtacattgtctttgatgtgcttgcccagttctttgcccacgatgatccctggatcgtccttgctgccctggagctgtacatccgacgagcttgcaaggcctactccatcctggacatcaactaccaccaggactcggacctgcctcccgtcatctcgtggcgatttagactgcctaccatgtcgtctgctttgtacaactcagtagtgtcttctggctccaaaacccccacttccccctcggtgtctcgagctgattccgtctccgacttttcgtacaccgttgagcgagactctgctcccgctcgaaccggagcgattgttgccgtgcctcatctggatgatctggaggatgctctgactcgtgttctggagaacctgcccaaacggggcgctggtcttgccatctctgttggtgctagcaacaagagtgccgctgcttctgctcgtgacgctgctgctgctgccgcttcatccgttgacactggcctgtccaacatttgcaacgttatgattggtcgggttgatgagtctgatgacgacgacactctgattgcccgaatctcccaggtcattgaggactttaaggaggactttgaggcctgttctctgcgacgaatcaccttctccttcggcaactcccgaggtacttatcccaagtatttcacgttccgaggccccgcatacgaggaggaccccactatccgacacattgagcctgctctggccttccagctggagctcgcccgtctgtccaacttcgacatcaagcctgtccacaccgacaaccgaaacatccacgtgtacgaggctactggcaagaacgctgcttccgacaagcggttcttcacccgaggtatcgtacgacctggtcgtcttcgagagaacatccccacctcggagtatctcatttccgaggctgaccggctcatgagcgatattttggacgctctagaggtgattggaaccaccaactcggatctcaaccacattttcatcaacttctcagccgtctttgctctgaagcccgaggaggttgaagctgcctttggcggtttcctggagcgatttggccgacgtctgtggcgacttcgagtcaccggtgccgagatccgaatgatggtatccgaccccgaaactggctctgctttccctctgcgagcaatgatcaacaacgtctctggttacgttgtgcagtctgagctgtacgctgaggccaagaacgacaagggccagtggattttcaagtctctgggcaagcccggctccatgcacatgcggtctatcaacactccctaccccaccaaggagtggctgcagcccaagcggtacaaggcccatctgatgggtaccacctactgctatgacttccccgagctgttccgacagtccattgagtcggactggaagaagtatgacggcaaggctcccgacgatctcatgacttgcaacgagctgattctcgatgaggactctggcgagctgcaggaggtgaaccgagagcccggcgccaacaacgtcggtatggttgcgtggaagtttgaggccaagacccccgagtaccctcgaggccgatctttcatcgtggtggccaacgatatcaccttccagattggttcgtttggccctgctgaggaccagttcttcttcaaggtgacggagctggctcgaaagctcggtattcctcgaatctatctgtctgccaactctggtgctcgaatcggcattgctgacgagctcgttggcaagtacaaggttgcgtggaacgacgagactgacccctccaagggcttcaagtacctttacttcacccctgagtctcttgccaccctcaagcccgacactgttgtcaccactgagattgaggaggagggtcccaacggcgtggagaagcgtcatgtgatcgactacattgtcggagagaaggacggtctcggagtcgagtgtctgcggggctctggtctcattgcaggcgccacttctcgagcctacaaggatatcttcactctcactcttgtcacctgtcgatccgttggtatcggtgcttaccttgttcgtcttggtcaacgagccatccagattgagggccagcccatcattctcactggtgcccccgccatcaacaagctgcttggtcgagaggtctactcttccaacttgcagcttggtggtactcagatcatgtacaacaacggtgtgtctcatctgactgcccgagatgatctcaacggtgtccacaagatcatgcagtggctgtcatacatccctgcttctcgaggtcttccagtgcctgttctccctcacaagaccgatgtgtgggatcgagacgtgacgttccagcctgtccgaggcgagcagtacgatgttagatggcttatttctggccgaactctcgaggatggtgctttcgagtctggtctctttgacaaggactctttccaggagactctgtctggctgggccaagggtgttgttgttggtcgagctcgtcttggcggcattcccttcggtgtcattggtgtcgagactgcgaccgtcgacaatactacccctgccgatcccgccaacccggactctattgagatgagcacctctgaagccggccaggtttggtaccccaactcggccttcaagacctctcaggccatcaacgacttcaaccatggtgaggcgcttcctctcatgattcttgctaactggcgaggcttttctggtggtcagcgagacatgtacaatgaggttctcaagtacggatctttcattgttgatgctctggttgactacaagcagcccatcatggtgtacatccctcccaccggtgagctgcgaggtggttcttgggttgtggttgaccccaccatcaactcggacatgatggagatgtacgctgacgtcgagtctcgaggtggtgtgctggagcccgagggaatggtcggtatcaagtaccgacgagacaagctactggacaccatggctcgtctggatcccgagtactcctctctcaagaagcagcttgaggagtctcccgattctgaggagctcaaggtcaagctcagcgtgcgagagaagtctctcatgcccatctaccagcagatctccgtgcagtttgccgacttgcatgaccgagctggccgaatggaggccaagggtgtcattcgtgaggctcttgtgtggaaggatgctcgtcgattcttcttctggcgaatccgacgacgattagtcgaggagtacctcattaccaagatcaatagcattctgccctcttgcactcggcttgagtgtctggctcgaatcaagtcgtggaagcctgccactcttgatcagggctctgaccggggtgttgccgagtggtttgacgagaactctgatgccgtctctgctcgactcagcgagctcaagaaggacgcttctgcccagtcgtttgcttctcaactgagaaaggaccgacagggtactctccagggcatgaagcaggctctcgcttctctttctgaggctgagcgggctgagctgctcaaggggttgtga

SEQ ID NO: 36 - protein, 2266 aa, Yarrowia lipolytica
MRLQLRTLTRRFFSMASGSSTPDVAPLVDPNIHKGLASHFFGLNSVHTAKPSKVKEFVASHGGHTVINKVLIANNGIAAVKEIRSVRKWAYETFGDERAISFTVMATPEDLAANADYIRMADQYVEVPGGTNNNNYANVELIVDVAERFGVDAVWAGWGHASENPLLPESLAASPRKIVFIGPPGAAMRSLGDKISSTIVAQHAKVPCIPWSGTGVDEVVVDKSTNLVSVSEEVYTKGCTTGPKQGLEKAKQIGFPVMIKASEGGGGKGIRKVEREEDFEAAYHQVEGEIPGSPIFIMQLAGNARHLEVQLLADQYGNNISLFGRDCSVQRRHQKIIEEAPVTVAGQQTFTAMEKAAVRLGKLVGYVSAGTVEYLYSHEDDKFYFLELNPRLQVEHPTTEMVTGVNLPAAQLQIAMGIPLDRIKDIRLFYGVNPHTTTPIDFDFSGEDADKTQRRPVPRGHTTACRITSEDPGEGFKPSGGTMHELNFRSSSNVWGYFSVGNQGGIHSFSDSQFGHIFAFGENRSASRKHMVVALKELSIRGDFRTTVEYLIKLLETPDFEDNTITTGWLDELISNKLTAERPDSFLAVVCGAATKAHRASEDSIATYMASLEKGQVPARDILKTLFPVDFIYEGQRYKFTATRSSEDSYTLFINGSRCDIGVRPLSDGGILCLVGGRSHNVYWKEEVGATRLSVDSKTCLLEVENDPTQLRSPSPGKLVKFLVENGDHVRANQPYAEIEVMKMYMTLTAQEDGIVQLMKQPGSTIEAGDILGILALDDPSKVKHAKPFEGQLPELGPPTLSGNKPHQRYEHCQNVLHNILLGFDNQVVMKSTLQEMVGLLRNPELPYLQWAHQVSSLHTRMSAKLDATLAGLIDKAKQRGGEFPAKQLLRALEKEASSGEVDALFQQTLAPLFDLAREYQDGLAIHELQVAAGLLQAYYDSEARFCGPNVRDEDVILKLREENRDSLRKVVMAQLSHSRVGAKNNLVLALLDEYKVADQAGTDSPASNVHVAKYLRPVLRKIVELESRASAKVSLKAREILIQCALPSLKERTDQLEHILRSSVVESRYGEVGLEHRTPRADILKEVVDSKYIVFDVLAQFFAHDDPWIVLAALELYIRRACKAYSILDINYHQDSDLPPVISWRFRLPTMSSALYNSVVSSGSKTPTSPSVSRADSVSDFSYTVERDSAPARTGAIVAVPHLDDLEDALTRVLENLPKRGAGLAISVGASNKSAAASARDAAAAAASSVDTGLSNICNVMIGRVDESDDDDTLIARISQVIEDFKEDFEACSLRRITFSFGNSRGTYPKYFTFRGPAYEEDPTIRHIEPALAFQLELARLSNFDIKPVHTDNRNIHVYEATGKNAASDKRFFTRGIVRPGRLRENIPTSEYLISEADRLMSDILDALEVIGTTNSDLNHIFINFSAVFALKPEEVEAAFGGFLERFGRRLWRLRVTGAEIRMMVSDPETGSAFPLRAMINNVSGYVVQSELYAEAKNDKGQWIFKSLGKPGSMHMRSINTPYPTKEWLQPKRYKAHLMGTTYCYDFPELFRQSIESDWKKYDGKAPDDLMTCNELILDEDSGELQEVNREPGANNVGMVAWKFEAKTPEYPRGRSFIVVANDITFQIGSFGPAEDQFFFKVTELARKLGIPRIYLSANSGARIGIADELVGKYKVAWNDETDPSKGFKYLYFTPESLATLKPDTVVTTEIEEEGPNGVEKRHVIDYIVGEKDGLGVECLRGSGLIAGATSRAYKDIFTLTLVTCRSVGIGAYLVRLGQRAIQIEGQPIILTGAPAINKLLGREVYSSNLQLGGTQIMYNNGVSHLTARDDLNGVHKIMQWLSYIPASRGLPVPVLPHKTDVWDRDVTFQPVRGEQYDVRWLISGRTLEDGAFESGLFDKDSFQETLSGWAKGVVVGRARLGGIPFGVIGVETATVDNTTPADPANPDSIEMSTSEAGQVWYPNSAFKTSQAINDFNHGEALPLMILANWRGFSGGQRDMYNEVLKYGSFIVDALVDYKQPIMVYIPPTGELRGGSWVVVDPTINSDMMEMYADVESRGGVLEPEGMVGIKYRRDKLLDTMARLDPEYSSLKKQLEESPDSEELKVKLSVREKSLMPIYQQISVQFADLHDRAGRMEAKGVIREALVWKDARRFFFWRIRRRLVEEYLITKINSILPSCTRLECLARIKSWKPATLDQGSDRGVAEWFDENSDAVSARLSELKKDASAQSFASQLRKDRQGTLQGMKQALASLSEAERAELLKGL

SEQ ID NO: 37 - DNA, 2142 bp, Aspergillus nidulans
  CDS (1)..(2142): GeneID: 2871016; (coordinates 811656 to 814126) encoding ACC1 [Protein ID - C8V2U7]
atggttgatgcgtatacctgcacagccggtgctgaagatccgcttgtccctgcgagaccgccagtcagcttccacgatacattatggcgacgagcacggcgaaccccagcaccacggggaagagggtcaatgtcctcgtctactctgttctcaggagatggaaccaccgtcgaatctgtccgccactgcctctacaccctccgccgtctcctagcctcccgttatgctgtaatccctgttacagcagacatgctcatcaaggagccatggacacttacgtgtgccttactcgttattcccggtggcgcggacctaggctactgccgcgcgctcaatggtgcaggtaatcgcaggatcgaacaattcgttcgccgcggaggcgcttaccttggtttttgtgccgggggatactatgggactaaacgctgcgagttcgagctcggcgataaaacaatggaggttattggggagcgcgagctagctttctatccaggcatttgtcgcggaggggcttttaagggcttcgtctaccatagcgaggtgggcgcaagggctgcggagctgacggtttcgaaggatgcactaagcgctggtgtaatcccgtcgagttttcggtcatactataatggtggtggggtgtttgtcgatgcgccgttgtatgcggatagaggcgttgaggttcttgcgagctacgcggagcgtctcaacgtgaatccgggttctggcgctgcggcggtggtgtattgtcctgttggcgatggcgcggcaattttgactgggccacatcctgaatttgcggccgttaacctcaatccgaaagctggaggtcccgaatacgctgaagtagtcgaggctttggcagcggacgacaaggcccgtaccgacttcctgaaggcttgtctgtccaagctagggttgcaggtggcgcaggaaacaacgcatgtaccctctctatcgtctctgcatttctcgtctttgtcatctggtgatgcagaacgagtgctaaaatcgcttgaagaactagctggcgacgagggccttttcaaagacgagtacgacacctttagaatcgagaagtggggtacgtataatatgggggccctcacagagtcacttcctgaatccaaggaagcctcatcggaacttcatgagagtgaaggaattgtggattaccagtcaatcgtcaaacgcatcattgttcatgaagatgtcccgtcgtcaaaaacaacaccatacttcaaccatcatgccttttacagccatctgcgggactatcaggcgcagtcgaaggaaggtgcttcgcttttcggctcaaatctcttatatggcgaagtcgttaccagcaccaacactattcttgaaagaaatgccaagatcctccgcaaattgcccacgggcacaactgcaaccgctactacccaagtagcaggacgaggacgaggatccaacgtctgggtctccccagccgggtctctcatgttctcaactgtagtacgccacccaatggagaaaatgcagtctgctccggtcgtcctcatccagtacctcgccgcgttggcagtagttcagggcgtacgtagttacgatgagggctatgacgccgtgccagtcaagctgaaatggcccaatgatatctacgcgttggaccccggcgaacctgaacacaagaaacaatacaccaagatctgcggcatccttgtcaactcccaatactcttctaatgaatatacctctgtcgtcggcatcggcgttaacgccaccaacgcctccccaacaacgtccctgacagccctggctgctcgctttgtaggccacaaggcggctcctattacccttgagaaactcctcgcgcgtattctgactgtctttgaagacctttatactcggttcctccgcacaggcttcgacagaagtttcgaggagatgtactacgaggcctggctgcataccaaccagatcgttacgcttgaggctgagggaggtaccagggcgagaatcaagggagttacacgtgattatgggttgctccttgctgaagaacttagttgggatgaccggcctacgggaagagtgtggcagctgcagagtgatagtaatagcttcgattttatgaagggtttgttgaagaggaaagttaattga

SEQ ID NO: 38 - protein, 713 aa, Aspergillus nidulans
MVDAYTCTAGAEDPLVPARPPVSFHDTLWRRARRTPAPRGRGSMSSSTLFSGDGTTVESVRHCLYTLRRLLASRYAVIPVTADMLIKEPWTLTCALLVIPGGADLGYCRALNGAGNRRIEQFVRRGGAYLGFCAGGYYGTKRCEFELGDKTMEVIGERELAFYPGICRGGAFKGFVYHSEVGARAAELTVSKDALSAGVIPSSFRSYYNGGGVFVDAPLYADRGVEVLASYAERLNVNPGSGAAAVVYCPVGDGAAILTGPHPEFAAVNLNPKAGGPEYAEVVEALAADDKARTDFLKACLSKLGLQVAQETTHVPSLSSLHFSSLSSGDAERVLKSLEELAGDEGLFKDEYDTFRIEKWGTYNMGALTESLPESKEASSELHESEGIVDYQSIVKRIIVHEDVPSSKTTPYFNHHAFYSHLRDYQAQSKEGASLFGSNLLYGEVVTSTNTILERNAKILRKLPTGTTATATTQVAGRGRGSNVWVSPAGSLMFSTVVRHPMEKMQSAPVVLIQYLAALAVVQGVRSYDEGYDAVPVKLKWPNDIYALDPGEPEHKKQYTKICGILVNSQYSSNEYTSVVGIGVNATNASPTTSLTALAARFVGHKAAPITLEKLLARILTVFEDLYTRFLRTGFDRSFEEMYYEAWLHTNQIVTLEAEGGTRARIKGVTRDYGLLLAEELSWDDRPTGRVWQLQSDSNSFDFMKGLLKRKVN

SEQ ID NO: 39 - DNA, 741 bp, Escherichia coli
  CDS (1)..(741): GeneID: 4491405; (coordinates 918973 to 919770) encoding Pyruvate Formate Lyase A (Pfl A)
atgtcagttattggtcgcattcactcctttgaatcctgtggaaccgtagacggcccaggtattcgctttatcacctttttccagggctgcctgatgcgctgcctgtattgtcataaccgcgacacctgggacacgcatggcggtaaagaagttaccgttgaagatttgatgaaggaagtggtgacctatcgccactttatgaacgcttccggcggcggcgttaccgcatccggcggtgaagcaatcctgcaagctgagtttgttcgtgactggttccgcgcctgcaaaaaagaaggcattcatacctgtctggacaccaacggttttgttcgtcgttacgatccggtgattgatgaactgctggaagtaaccgacctggtaatgctcgatctcaaacagatgaacgacgagatccaccaaaatctggttggagtttccaaccaccgcacgctggagttcgctaaatatctggcgaacaaaaatgtgaaggtgtggatccgctacgttgttgtcccaggctggtctgacgatgacgattcagcgcatcgcctcggtgaatttacccgtgatatgggcaacgttgagaaaatcgagcttctcccctaccacgagctgggcaaacacaaatgggtggcaatgggtgaagagtacaaactcgacggtgttaaaccaccgaagaaagagaccatggaacgcgtgaaaggcattcttgagcagtacggtcataaggtaatgttctaa

SEQ ID NO: 40 - protein, 246 aa, Escherichia coli
MSVIGRIHSFESCGTVDGPGIRFITFFQGCLMRCLYCHNRDTWDTHGGKEVTVEDLMKEVVTYRHFMNASGGGVTASGGEAILQAEFVRDWFRACKKEGIHTCLDTNGFVRRYDPVIDELLEVTDLVMLDLKQMNDEIHQNLVGVSNHRTLEFAKYLANKNVKVWIRYVVVPGWSDDDDSAHRLGEFTRDMGNVEKIELLPYHELGKHKWVAMGEEYKLDGVKPPKKETMERVKGILEQYGHKVMF

SEQ ID NO: 41 - protein, 265 aa, Escherichia coli
  PEPTIDE (1)..(265): Pyruvate formate lyase A - Protein ID A1A9E2
MSNLTNCNTIENTAAAGATKSVIGRIHSFESCGTVDGPGIRFITFFQGCLMRCLYCHNRDTWDTHGGKEVTVEDLMKEVVTYRHFMNASGGGVTASGGEAILQAEFVRDWFRACKKEGIHTCLDTNGFVRRYDPVIDELLEVTDLVMLDLKQMNDEIHQNLVGVSNHRTLEFAKYLANKNVKVWIRYVVVPGWSDDDDSAHRLGEFTRDMGNVEKIELLPYHELGKHKWVAMGEEYKLDGVKPPKKETMERVKGILEQYGHKVMF

SEQ ID NO: 42 - DNA, 2283 bp, Escherichia coli
  CDS (1)..(2283): GeneID: 4494334; (coordinates 954751 to 957033) encoding Pyruvate formate lyase B (PflB)  [Protein ID - A1A9I0]
atgtccgagcttaatgaaaagttagccacagcctgggaaggttttaccaaaggtgactggcagaatgaagtaaacgtccgtgacttcattcagaaaaactacactccgtacgagggtgacgagtccttcctggctggcgctactgaagcgaccaccaccctgtgggacaaagtaatggaaggcgttaaactggaaaaccgcactcacgcgccagttgactttgacaccgctgttgcttccaccatcacctctcacgacgctggctacatcaacaagcagcttgagaaaatcgttggtctgcagactgaagctccgctgaaacgtgctcttatcccgttcggtggtatcaaaatgatcgaaggttcctgcaaagcgtacaaccgcgaactggatccgatgatcaaaaaaatcttcactgaataccgtaaaactcacaaccagggcgtgttcgacgtttacactccggacatcctgcgttgccgtaaatctggtgttctgaccggtctgccagatgcatatggccgtggccgtatcatcggtgactaccgtcgcgttgcgctgtacggtatcgactacctgatgaaagacaaactggcacagttcacttctctgcaggctgatctggaaaacggcgtaaacctggaacagactatccgtctgcgcgaagaaatcgctgaacagcaccgcgctctgggtcagatgaaagaaatggctgcgaaatacggctacgacatctctggtccggctaccaacgctcaggaagctatccagtggacttacttcggctacctggctgctgttaagtctcagaacggtgctgcaatgtccttcggtcgtacctccaccttcctggatgtgtacatcgaacgtgacctgaaagctggcaagatcaccgaacaagaagcgcaggaaatggttgaccacctggtcatgaaactgcgtatggttcgcttcctgcgtactccggaatacgatgaactgttctctggcgacccgatctgggcaaccgaatctatcggtggtatgggcctcgacggtcgtaccctggttaccaaaaacagcttccgtttcctgaacaccctgtacaccatgggtccgtctccggaaccgaacatgaccattctgtggtctgaaaaactgccgctgaacttcaagaaattcgccgctaaagtgtccatcgacacctcttctctgcagtatgagaacgatgacctgatgcgtccggacttcaacaacgatgactacgctattgcttgctgcgtaagcccgatgatcgttggtaaacaaatgcagttcttcggtgcgcgtgcaaacctggcgaaaaccatgctgtacgcaatcaacggcggcgttgacgaaaaactgaaaatgcaggttggtccgaagtctgaaccgatcaaaggcgatgtcctgaactatgatgaagtgatggagcgcatggatcacttcatggactggctggctaaacagtacatcactgcactgaacatcatccactacatgcacgacaagtacagctacgaagcctctctgatggcgctgcacgaccgtgacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtaacaatgatccgcgtgtagatgacctggctgttgacctggtagaacgtttcatgaagaaaattcagaaactgcacacctaccgtgacgctatcccgactcagtctgttctgaccatcacttctaacgttgtgtatggtaagaaaacgggtaacaccccagacggtcgtcgtgctggcgcgccgttcggaccgggtgctaacccgatgcacggtcgtgaccagaaaggtgcagtagcctctctgacttccgttgctaaactgccgtttgcttacgctaaagatggtatctcctacaccttctctatcgttccgaacgcactgggtaaagacgacgaagttcgtaagaccaacctggctggtctgatggatggttacttccaccacgaagcatccatcgaaggtggtcagcacctgaacgttaacgtgatgaaccgtgaaatgctgctcgacgcgatggaaaacccggaaaaatatccgcagctgaccatccgtgtatctggctacgcagtacgtttcaactcgctgactaaagaacagcagcaggacgttattactcgtaccttcactcaatctatgtaa

SEQ ID NO: 43 - protein, 760 aa, Escherichia coli
MSELNEKLATAWEGFTKGDWQNEVNVRDFIQKNYTPYEGDESFLAGATEATTTLWDKVMEGVKLENRTHAPVDFDTAVASTITSHDAGYINKQLEKIVGLQTEAPLKRALIPFGGIKMIEGSCKAYNRELDPMIKKIFTEYRKTHNQGVFDVYTPDILRCRKSGVLTGLPDAYGRGRIIGDYRRVALYGIDYLMKDKLAQFTSLQADLENGVNLEQTIRLREEIAEQHRALGQMKEMAAKYGYDISGPATNAQEAIQWTYFGYLAAVKSQNGAAMSFGRTSTFLDVYIERDLKAGKITEQEAQEMVDHLVMKLRMVRFLRTPEYDELFSGDPIWATESIGGMGLDGRTLVTKNSFRFLNTLYTMGPSPEPNMTILWSEKLPLNFKKFAAKVSIDTSSLQYENDDLMRPDFNNDDYAIACCVSPMIVGKQMQFFGARANLAKTMLYAINGGVDEKLKMQVGPKSEPIKGDVLNYDEVMERMDHFMDWLAKQYITALNIIHYMHDKYSYEASLMALHDRDVIRTMACGIAGLSVAADSLSAIKYAKVKPIRDEDGLAIDFEIEGEYPQFGNNDPRVDDLAVDLVERFMKKIQKLHTYRDAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQSM

SEQ ID NO: 44 - DNA, 1131 bp, Saccharomyces cerevisiae
  CDS (1)..(1131): GeneID: 854570 (coordinates 1071791 to 1072921) encoding FDH - [ Protein ID - Q08911]
atgtcgaagggaaaggttttgctggttctttacgaaggtggtaagcatgctgaagagcaggaaaagttattggggtgtattgaaaatgaacttggtatcagaaatttcattgaagaacagggatacgagttggttactaccattgacaaggaccctgagccaacctcaacggtagacagggagttgaaagacgctgaaattgtcattactacgccctttttccccgcctacatctcgagaaacaggattgcagaagctcctaacctgaagctctgtgtaaccgctggcgtcggttcagaccatgtcgatttagaagctgcaaatgaacggaaaatcacggtcaccgaagttactggttctaacgtcgtttctgtcgcagagcacgttatggccacaattttggttttgataagaaactataatggtggtcatcaacaagcaattaatggtgagtgggatattgccggcgtggctaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctggatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 45 - protein, 376 aa, Saccharomyces cerevisiae
MSKGKVLLVLYEGGKHAEEQEKLLGCIENELGIRNFIEEQGYELVTTIDKDPEPTSTVDRELKDAEIVITTPFFPAYISRNRIAEAPNLKLCVTAGVGSDHVDLEAANERKITVTEVTGSNVVSVAEHVMATILVLIRNYNGGHQQAINGEWDIAGVAKNEYDLEDKIISTVGAGRIGYRVLERLVAFNPKKLLYYDYQELPAEAINRLNEASKLFNGRGDIVQRVEKLEDMVAQSDVVTINCPLHKDSRGLFNKKLISHMKDGAYLVNTARGAICVAEDVAEAVKSGKLAGYGGDVWDKQPAPKDHPWRTMDNKDHVGNAMTVHISGTSLDAQKRYAQGVKNILNSYFSKKFDYRPQDIIVQNGSYATRAYGQKK

SEQ ID NO: 46 - DNA, 603 bp, Candida tropicalis
  CDS (1)..(603): GeneID: 8300341 (coordinates 1778439 to 1779041) encoding FDH [Protein ID - C5M8W6]
atgaccaagcctttgattttaatggttctctaccctggagacaaacattctactgatgaacctagattattgggaacagttgagaatgaattaggtattagaaagtttgttgaagaacatggttacgaattgatcactactgctaacaaaactcctgctcctacctccacttttgacaagtatttaccagaagctgaaattatcatcaccactccattttaccctgcttatcttaccaaagaaagattggccactgcaaaaaagttgaaattatgtatcactgctggtgttggttccgataactatgatcttgaagctttgaatgaaaaaggaattgccgtgttggaagtgactggttctaatgtccaatctgttgctgaacatgctgttatgaccatgctgatcttactcagaaactacggtgaaggtcaccaccaagccgtcagtggtggttgggatattgctgctgttgccaaagacgaattcgatatggaaggtaaagtttttgctaccgttggtgctggtagaattggttacagaatcttggaaagattagttgccttcaacccaaagaagttgttgtactacgactaccaagcataa

SEQ ID NO: 47 - protein, 200 aa, Candida tropicalis
MTKPLILMVLYPGDKHSTDEPRLLGTVENELGIRKFVEEHGYELITTANKTPAPTSTFDKYLPEAEIIITTPFYPAYLTKERLATAKKLKLCITAGVGSDNYDLEALNEKGIAVLEVTGSNVQSVAEHAVMTMLILLRNYGEGHHQAVSGGWDIAAVAKDEFDMEGKVFATVGAGRIGYRILERLVAFNPKKLLYYDYQA

SEQ ID NO: 48 - DNA, 3021 bp, Yarrowia lipolytica
  CDS (1)..(3021): GeneID: 2907923 (coordinates 3836266 to 3839286) encoding FDH [Protein ID - Q6BZU8]
atgtgccaaaacctaattaggtggaggttaaagtatgaaaatattctctggagtcatcttttagccaactacaccaccagtctagtctatcaccaactacttatgaccatgtcgcgtctggttcgacggcttcctggccgaattcccacttttcgagtggcccattcgctcagcttgtctgctcttcgtcactatgccactgccaccaacattgacggcaagcaaatggcaaaggacattcgactagagctccacgacgagatcaagcagattcaggctaagaaaccccatttccaacccaagctgattataattcaagtcggcgagcgtcccgactctagtgcctacgtgcgtatgaagctcaaggctgctcgagaggcccagattgactgcgagctgcgaaagttctccgaggacatggccgaggaccaccttctggaggaattggacatcctgaatgacgatccttccgttcacggtattcttgtccagctgcctcttcccaagcacatcaacgagacccgaatcaccgattctgtcatcactgccaaggacgttgatggttttggccccctcaacgttggagagctttccaagcggggtggaaaccccgccttcgttccctgcacccccaagggtgtcatggagatgctggatcgatctggcattgagctgcgaggcaagaatgccgttgtcattggccgatccgatattgtcggtacccccgtcgcctctctccttaagggcgctgatgccaccgtcaccgtctgccatagatacaccgagaaccttcctgccattgtcaagaacgccgatgtcgttgttgctgccattggagctcctaactttgtcaagggcgagtggctcaagcccggcgctgtcgttgtcgatgttggcatcaactacgtcaaggatgagactaagaagtccggtcagcgacttgtcggagacgttgactttgactctgccaaggaggttgcttctttcattactcccgttcccggaggagtgggtcccatgaccgtggccatgctggtcaacaacgtggtcactgccgcaaaacgacagtccctcgagcaacagaagatgcaggtcaagcccctgcctctcaaactgcgaacgcccgttccttctgacgatgccatctctcgagcacagatccccaagaacgtcaagacagttgccaaggaggccggactcaccgagcacgagtttgagccctatggagcttacaagggtaaggtctctctgacaaccttggaccgactcaaggaccgaaaggacggtaagtacgttcttgtggccggaatcacccccactcctcttggagagggtaagtctaccaccaccgttggtcttgttcaggccatgtgtgcccacctcggcaagctagcctttgctaatgtccgacaaccctccatgggtcccacttttggtatcaagggtggtgctgccggtggcggatacgcccaggtcattcccatggacgagttcaacatgcatctgactggtgacattcacgccatttctgctgccaccaacctgctggccgccgctattgacacccgaatgttccacgagtcgtcccagaaggacgccgctctttacaagcggctggttccctccgtcaagggcaagcgacagttcattccctcgcagctgcagcgactagagaagttgggcatcaacaagactaaccccaacgacctgactgatgaggaaatcagcaagtttgttcgacttgacatcgatcctgagaccatcacctggaagcgggttgtcgactgcaacgatcgacttctgcgaggtatcaccgttggagagggccccagcgaaaaaggccgaacccgagagactggattcgacatttctgtcgcctctgagtgtatggctattctcgctctgtccaactctctcgccgatatgagacgacgacttggaaacatggtggttgcctcttctcgagagggccttcccgtcacttgtgacgacattggagctggcggagctctcactgccctgatgaaggatgccatcaagcccaacctcatgcagaccctggagggaacccccgtcttcgtgcatgccggtcctttcgccaacatttccattggtgcttcttctgtcctcgccgataagattgctctcaagttggctggtaccaagacaaagggcgacgagcccggttacgtggtcactgaggctggtttcgacttcaccatgggtggagagagattcttcaatatcaagtgccgagactccggtcttgttcccgacgccgttgtcattgtcgcaactgttcgagccctcaagctgcacggtggaggacccgaggttaagcccggtgcccagctcgcccccgagtatcagaacgagaacgttgacctggttactgctggtgccaagaatctcggcaagcaaattgagaacgcccgatctttcggtgttcccgtcgttgtcgccattaaccaattcgccacagatactcctgccgagattgaggccatccgaactgctgctctcaaggctggtgccgccgaggccattgtctccaaccattgggaaaagggtggagagggagccattgatctcgccaagggtgtcgtcaaggtttgtagccagactgacaacgtcgagaagaaccccaacttcaagttcctttacgatatcgacacctctgccgaggagaagctcaacaccatcgccaaggagatgtacggtgccaaaggcattgagctgtcgcctctcgctcgaaagaagattgacacctacactgcccagggctttggaaaccttcccatctgcattgccaagacccagtactctctgtcacacgaccctgccctcaagggtgtacccaaggacttcgtcgtgcccattcgagacgtgcgagcatctgttggtgctggttacctctatgctctggctgccgacattatgaccattcctggtctgcctactagacctggctatatgaacgtcgaggtcgactccaagggccagatcgagggtctgttttaa

SEQ ID NO: 49 - protein, 1006 aa, Yarrowia lipolytica
MCQNLIRWRLKYENILWSHLLANYTTSLVYHQLLMTMSRLVRRLPGRIPTFRVAHSLSLSALRHYATATNIDGKQMAKDIRLELHDEIKQIQAKKPHFQPKLIIIQVGERPDSSAYVRMKLKAAREAQIDCELRKFSEDMAEDHLLEELDILNDDPSVHGILVQLPLPKHINETRITDSVITAKDVDGFGPLNVGELSKRGGNPAFVPCTPKGVMEMLDRSGIELRGKNAVVIGRSDIVGTPVASLLKGADATVTVCHRYTENLPAIVKNADVVVAAIGAPNFVKGEWLKPGAVVVDVGINYVKDETKKSGQRLVGDVDFDSAKEVASFITPVPGGVGPMTVAMLVNNVVTAAKRQSLEQQKMQVKPLPLKLRTPVPSDDAISRAQIPKNVKTVAKEAGLTEHEFEPYGAYKGKVSLTTLDRLKDRKDGKYVLVAGITPTPLGEGKSTTTVGLVQAMCAHLGKLAFANVRQPSMGPTFGIKGGAAGGGYAQVIPMDEFNMHLTGDIHAISAATNLLAAAIDTRMFHESSQKDAALYKRLVPSVKGKRQFIPSQLQRLEKLGINKTNPNDLTDEEISKFVRLDIDPETITWKRVVDCNDRLLRGITVGEGPSEKGRTRETGFDISVASECMAILALSNSLADMRRRLGNMVVASSREGLPVTCDDIGAGGALTALMKDAIKPNLMQTLEGTPVFVHAGPFANISIGASSVLADKIALKLAGTKTKGDEPGYVVTEAGFDFTMGGERFFNIKCRDSGLVPDAVVIVATVRALKLHGGGPEVKPGAQLAPEYQNENVDLVTAGAKNLGKQIENARSFGVPVVVAINQFATDTPAEIEAIRTAALKAGAAEAIVSNHWEKGGEGAIDLAKGVVKVCSQTDNVEKNPNFKFLYDIDTSAEEKLNTIAKEMYGAKGIELSPLARKKIDTYTAQGFGNLPICIAKTQYSLSHDPALKGVPKDFVVPIRDVRASVGAGYLYALAADIMTIPGLPTRPGYMNVEVDSKGQIEGLF

SEQ ID NO: 50 - DNA, 2079 bp, Escherichia coli
  CDS (1)..(2079): GeneID: 8486957 (coordinates 3419739 to 3421817) encoding Formate hydrogen lyase [Protein ID - C8UET5]
atgtcatatacaccgatgagtgatctcggacaacaagggttgttcgacatcactcggacactattgcagcagcccgatctggcctcgctgtgtgaggctctttcgcaactggtaaagcgttctgcgctcgccgacaacgcggctattgtgttgtggcaagcgcagactcaacgtgcgtcttattacgcgtcgcgtgaaaaagacacccccattaaatatgaagacgaaactgttctggcacacggtccggtacgcagcattttgtcgcgccctgatacgctgcattgcagttacgaagaattttgtgaaacctggccgcagctggacgcaggtgggctatacccaaaatttggtcactattgcctgatgccactggcggcggaagggcatatttttggtggctgtgaatttattcgttatgacgatcgcccctggagcgaaaaagagttcaatcgtctgcaaacatttacgcagatcgtttctgtcgtcaccgaacaaatccagagccgcgtcgttaacaatgtcgactatgagttgttatgccgggaacgcgataacttccgcatcctggtcgccatcaccaacgcggtgctttcccgcctggatatggacgaactggtcagcgaagtcgccaaagaaatccattactatttcgacattgacgatatcagtatcgtcttacgcagccaccgtaaaaacaaactcaacatctactccactcactatcttgataaacagcatcccgcccacgaacagagcgaagtcgatgaagccggaaccctcaccgaacgcgtgttcaaaagtaaagagatgctgctgatcaatctccacgagcgggacgatttagccccctatgaacgcatgttgttcgacacctggggcaaccagattcaaaccttgtgcctgttaccgctgatgtctggcgacaccatgctgggcgtgctgaaactggcgcaatgcgaagagaaagtgtttaccactaccaatctgaatttactgcgccagattgccgaacgtgtggcaatcgctgtcgataacgccctcgcctatcaggaaatccatcgtctgaaagaacggctggttgatgaaaacctcgccctgaccgagcagctcaacaatgttgatagtgaatttggcgagattattggccgcagcgaagccatgtacagcgtgcttaaacaagttgaaatggtggcgcaaagtgacagtaccgtgctgatcctcggtgaaactggcacgggtaaagagctgattgcccgtgcgatccataatctcagtgggcgtaataatcgccgcatggtcaaaatgaactgcgcggcgatgcctgccggattgctggaaagcgatctgtttggtcatgagcgtggggcttttaccggtgccagcgcccagcgtatcggtcgttttgaactggcggataaaagctccctgttcctcgacgaagtgggcgatatgccactggagttacagccgaagttgctgcgtgtattgcaggaacaggagtttgaacgtctcggcagcaacaaaatcattcagacggacgtgcgtctaatcgccgcgactaaccgcgatctgaaaaaaatggtcgccgaccgtgagttccgtagcgatctctattaccgcctgaacgtattcccgattcacctgccgccactacgcgagcgtccggaagatattccgctgctggcgaaagcctttaccttcaaaattgcccgtcgtctggggcgcaatatcgacagcattcctgccgagacgctgcgcaccttgagcaacatggagtggccgggtaacgtacgcgaactggaaaacgtcattgagcgcgcggtattgctaacacgcggtaacgtgctgcagctgtcattgccagatattgttttaccggaacctgaaacgccgcctgccgcaacggttgtcgccctggagggcgaagatgaatatcagttgattgtgcgcgtgctgaaagaaaccaacggcgtggttgccgggcctaaaggcgctgcgcaacgtctggggctgaaacgcacgaccctgctgtcacggatgaagcggctgggaattgataaatcggcattgatttaa

SEQ ID NO: 51 - protein, 692 aa, Escherichia coli
MSYTPMSDLGQQGLFDITRTLLQQPDLASLCEALSQLVKRSALADNAAIVLWQAQTQRASYYASREKDTPIKYEDETVLAHGPVRSILSRPDTLHCSYEEFCETWPQLDAGGLYPKFGHYCLMPLAAEGHIFGGCEFIRYDDRPWSEKEFNRLQTFTQIVSVVTEQIQSRVVNNVDYELLCRERDNFRILVAITNAVLSRLDMDELVSEVAKEIHYYFDIDDISIVLRSHRKNKLNIYSTHYLDKQHPAHEQSEVDEAGTLTERVFKSKEMLLINLHERDDLAPYERMLFDTWGNQIQTLCLLPLMSGDTMLGVLKLAQCEEKVFTTTNLNLLRQIAERVAIAVDNALAYQEIHRLKERLVDENLALTEQLNNVDSEFGEIIGRSEAMYSVLKQVEMVAQSDSTVLILGETGTGKELIARAIHNLSGRNNRRMVKMNCAAMPAGLLESDLFGHERGAFTGASAQRIGRFELADKSSLFLDEVGDMPLELQPKLLRVLQEQEFERLGSNKIIQTDVRLIAATNRDLKKMVADREFRSDLYYRLNVFPIHLPPLRERPEDIPLLAKAFTFKIARRLGRNIDSIPAETLRTLSNMEWPGNVRELENVIERAVLLTRGNVLQLSLPDIVLPEPETPPAATVVALEGEDEYQLIVRVLKETNGVVAGPKGAAQRLGLKRTTLLSRMKRLGIDKSALI

SEQ ID NO: 52 - DNA, 2276 bp, Chlamydomonas reinhardtii
  CDS (33)..(1220): GeneID: 5722109 (coordinates 2164944 to 2169549) encoding Acyl coa-acp thioesterase  [Protein ID - A8HY17]
tcacatacatttagatataccagccgataaaaatgcgtcgctttgcgacgttgaacgagcaggcacagtccactgcgtcaacttcgtcgtcgacccggtccgtgtgtgcacggatatgcagcaataggcgtcgtgcatcaattcagccgttaggcactgtcgcccttggccgtcgcagcggcgtcgcttgccgctcaggagtcgcggtgcaagcagcggcggtggttcaggaggagtatgacgttgttattcccaagttcccagccccagcagctggcgcgttcctgccggataagcgctcgttccgtgaggagcacaggatccgcggctacgaggtcagcccggaccagcgtgccaccatcgttactgtcgccaacctattgcaggaggtcgctggcaaccacgccgtgggcatgtggggccgcactgacgaggggtttgccagcctgcccagcatgaaggacctgctgttcgtcatgacacgcctgcaagtgcgcatgtacgagtaccccaagtggggcgacgtggttgctgtggagacgtacttcacggaggaggggcggctggcgttccggcgtgagtggaagctcatggacgtggccaccggcaagctgctgggcgcgggcaccagcacctgggtcaccatcaacacggccactcgccggctgtcgaagctgccggaggacgtgcgcaagcgcttcctgcgcttcgcgccgcccagcagcgtccacatcctgccccctgaggagaccaagaagaagctgcaggacatggagctgcccggccaggtccagtctgctcagcaggtggctcggcgcgcggacatggacatgaacggccacatcaacaacgtgacctacctggcctggacgctggagagcctgccggagcgggtcatgagcggcgggtacaagatgcaggagattgagctggacttcaaggccgagtgcacggctggcaacgccattgaggcgcactgcaaccccctggacgatcactccgcgtccttcgtgggacccgcgcccgccaacggcaacggcaacggccacgcagccgagcccgccgccgactccgcaccgctgtacttcctcagcatgctgcaaaagtgtgacgagaacgggtgtacggagctggtgcgggcgcgcacgacatggagccgtacgctggagggcgccaagccggcaccgccgccgctgtcggagctgtctgcggctcagtgaggaagtgtgtgaggttgtgtgcggcgtgaggacgtgtgcgtattgtgagtgcggcaggtgtgctttagttggatggttgtgagcggtcgccgcttgtgcaatcagtggtggcctggggataaagggcggatagtgagcacgggccgctggtgagctgtcatctggccaaggaaccgcaaggggttgagaagcaaggcatggggcccatggaagcggtcgcaattttgagaacttttgaacgcggtcacctatagcagcagcaggtttaggtttggtaagcgatggacggttgtgggctgcggctggagtgcatgaggtggtcggcgcgaacatgcgcagcggtgctggttgcgttgcatgcatttttcgtgtgggcagtgtgttggcaacctccagacccgagcatgtgtccgtgtgttgggctggtgacacgtgtctttcgcttcgacgccctggctgcgtaagcaggagagggcagcagctttcgtttgaggaggagggattgcacagcgacacgtttgagagccaggaggtcattcggtgagcattgcaactcccactcctggctgcgcgtttgcatgctggcaatcatcaggtgtttcattggcaatttgtattggtttattagggctcgcagctcgtaacaattacttatgttcggtgcggtttcagtggatatgctgacgcgtcgaccggaagagcgagtgcacgcccgatgcgcgggggtcaaagacgagagaaaggatgcaaatggcgtttaggctgctgccagcagtcccgccaacggcactgaccactgcgcggggcacgaagaaatggttcctagagtgagtgctgagtagagttcgtggctgtgatggagatgggtcgtgggtcatgtatgagggctgcgagttgcggcgtgcacacgcacagggcacggttgacggcagctagaccgtgcacggtgcgcctacatcaggagactggggatgagtgaggtgcaggcaggcatcagcattgcaagccggtaatgctgacgtatgtaacattgcaccctgtaacgatttagcgggc

SEQ ID NO: 53 - protein, 395 aa, Chlamydomonas reinhardtii
MRRFATLNEQAQSTASTSSSTRSVCARICSNRRRASIQPLGTVALGRRSGVACRSGVAVQAAAVVQEEYDVVIPKFPAPAAGAFLPDKRSFREEHRIRGYEVSPDQRATIVTVANLLQEVAGNHAVGMWGRTDEGFASLPSMKDLLFVMTRLQVRMYEYPKWGDVVAVETYFTEEGRLAFRREWKLMDVATGKLLGAGTSTWVTINTATRRLSKLPEDVRKRFLRFAPPSSVHILPPEETKKKLQDMELPGQVQSAQQVARRADMDMNGHINNVTYLAWTLESLPERVMSGGYKMQEIELDFKAECTAGNAIEAHCNPLDDHSASFVGPAPANGNGNGHAAEPAADSAPLYFLSMLQKCDENGCTELVRARTTWSRTLEGAKPAPPPLSELSAAQ

SEQ ID NO: 54 - protein, 412 aa, Arabidopsis thaliana
  PEPTIDE (1)..(412): Acyl coa-acp thioesterase (Protein ID - Q9SJE2)
MVATSATSSFFPVPSSSLDPNGKGNKIGSTNLAGLNSAPNSGRMKVKPNAQAPPKINGKKVGLPGSVDIVRTDTETSSHPAPRTFINQLPDWSMLLAAITTIFLAAEKQWMMLDWKPRRSDMLVDPFGIGRIVQDGLVFRQNFSIRSYEIGADRSASIETVMNHLQETALNHVKTAGLLGDGFGSTPEMFKKNLIWVVTRMQVVVDKYPTWGDVVEVDTWVSQSGKNGMRRDWLVRDCNTGETLTRASSVWVMMNKLTRRLSKIPEEVRGEIEPYFVNSDPVLAEDSRKLTKIDDKTADYVRSGLTPRWSDLDVNQHVNNVKYIGWILESAPVGIMERQKLKSMTLEYRRECGRDSVLQSLTAVTGCDIGNLATAGDVECQHLLRLQDGAEVVRGRTEWSSKTPTTTWGTAP

SEQ ID NO: 55 - DNA, 1179 bp, Ricinus communis
  CDS (1)..(1179): GeneID: 8269197; coordinates - 2160840 to 2162527 encoding Acyl coa-acp thioesterase  (Protein ID - B9RAC3)
atggcttcaaagggtagcattagattatacttcccttgtgattttcgcaatacgttacagaaaaagaacatgaaaatggacatggtcatggccaggtcaggattttcttattcccttaatccaattgcaccaaaaattccaagattttatgtggtggcaaatgctagcaatcctcaaagggtggacacaatcaatgggaaaaaggtgaacggaatacatgtagcagagagtagtaattcatatgcagatcagaataagatgaatgctactgcaggtttagtgctagatggtaatgtggatcatcaacctcttcacaaatggttgcttggaagatttgttgatgaaaggttggtctacagtcagaccttcattattaggtcttatgagattggtcctgacaaaactgccaccatggagacattgatgaatctccttcaggagactgcacttaaccatgtcacaagctcgggtcttgccggagatggctttggcgctactagagagatgagcctcaggaagctcatatgggttgtcactcgcatacatattcaagttcaaagatatagctgctggggagatgtggttgagattgatacttgggttgatggagcagggaagaatggaatgcgcagggattggataattcgagattataatactaaagaaatcataacacgagcaacaagcacatgggtgataatgaacagagaaacacgaaaactgtcgaaaatgccagaacaagtcaggcaagagttggtaccattctacacaaataggattgcaatagctaaggagaacaatgatgttgagaaaatcgataagcttactgatgaaactgcggagagaattcgatctggtcttgctccaagatggagtgacatggatgccaatcaacatgtaaataatgtaaaatacattggatggatcttggagagtgtgccaataaatgtcctggaagattacaatctgacaagcatgaccctggagtatagacgagagtgcagacaatcaaatctgctggaatccttaacaagcacaaccgagcattcaaataataattcctgcaaccgcaaagcacacttggagtatacgcacttgcttcggatgcaagctgacaaggcagagatcgtcagagcgagaacagaatggcaatccaaatccaacagaaaaaccatctaa

SEQ ID NO: 56 - protein, 392 aa, Ricinus communis
MASKGSIRLYFPCDFRNTLQKKNMKMDMVMARSGFSYSLNPIAPKIPRFYVVANASNPQRVDTINGKKVNGIHVAESSNSYADQNKMNATAGLVLDGNVDHQPLHKWLLGRFVDERLVYSQTFIIRSYEIGPDKTATMETLMNLLQETALNHVTSSGLAGDGFGATREMSLRKLIWVVTRIHIQVQRYSCWGDVVEIDTWVDGAGKNGMRRDWIIRDYNTKEIITRATSTWVIMNRETRKLSKMPEQVRQELVPFYTNRIAIAKENNDVEKIDKLTDETAERIRSGLAPRWSDMDANQHVNNVKYIGWILESVPINVLEDYNLTSMTLEYRRECRQSNLLESLTSTTEHSNNNSCNRKAHLEYTHLLRMQADKAEIVRARTEWQSKSNRKTI

SEQ ID NO: 57 - DNA, 1710 bp, Brassica napus
  CDS (169)..(1266): Genbank accession number:  X73849 encoding Acyl coa-acp thioesterase  (Protein ID - Q43745)
ggcgtcattgccaattggcgaaacaaccagctttttaatggcaatatcgtattttactaatctccaccttcctcgttaacatcgagcttcagatacaacacacagatccctgattcttcttctataaaccaaaacctcaggaaccataaaaaaaaaagggcatcaaaaatgttgaagctttcgtgtaatgtgactaaccacttacacaccttctccttcttctccgattcctcccttttcatcccggttaatcgccgtaccctcgccgtctcgtcttctcagccaaggaagccggctttagatcctcttcgggcagttatctccgccgatcagggaagcatcagccctgttaattcgtgtaccccggcggatcggttccgagctggtcgattgatggaagatggttattcttacaaagagaagttcattgttagaagctatgaggttgggattaacaaaaccgccaccgtcgagacaattgctaatctcttacaggaggtggcatgtaaccatgttcagaagtgtggattctcgaccgatggatttgccacaacactcaccatgaggaaattgcatctcatatgggtcactgcaagaatgcacattgagatctacaagtacccagcttggagtgatgttgttgagatagagacatggtgccagagtgaaggaaggattggaacgagacgtgattggattctaagggactctgctacaaatgaagttattgggcgtgctacaagcaagtgggtgatgatgaaccaagacacaaggcggcttcaaagagttacagatgaagttcgggacgagtacttggttttctgtcctcgagaacccagactagcgtttccagaagagaacaatagcagcttaaagaaaatcccaaaactagaagatccagctcagtattctatgctagagcttaagcctcggcgagctgatctggacatgaaccagcacgtgaataacgtcacctacattggatgggtgcttgagagcatacctcaagaaatcattgatacgcatgagcttcaagttataactctagattacagaagagaatgccagcaagatgacattgtagattcactcaccacctctgaaatccctgacgacccgatctcaaagcttaccgggaccaacggatctgccacgtcaagcatacaaggacacaatgagagccaattcttgcatatgctgaggttgtcagaaaatggccaggagatcaatcgtggaagaacacaatggagaaagaaatcctcacgatgattttcttatatgcttctccagtgttggtgaagttcttgcttcacgtttatagttttattgtgtcttttgatcagatctgttgtggggttagatggtactggattatttgtgtagtgtggcgtctgtgttgttcgttttctgtccaaattttgggctttaagcaaaacgtttcttaggtctgcttgtagcttttcataaactagatttgttcatccaattatatatgctgagtttctctgatgaaactgggtatgtgatgttggaggcaaaatttgcacaattaaaatttgtattacataagttttttggataagctaaagttgtatgcaatgtaatacttttttatttattggagattaataatattttaaataaaaaaaaaaaaaaaaaaaaaaaaaaaaaaaaaaaaaaaaaaaaaaaaaaaaaaaaaaaaaactcgag

SEQ ID NO: 58 - protein, 366 aa, Brassica napus
MLKLSCNVTNHLHTFSFFSDSSLFIPVNRRTLAVSSSQPRKPALDPLRAVISADQGSISPVNSCTPADRFRAGRLMEDGYSYKEKFIVRSYEVGINKTATVETIANLLQEVACNHVQKCGFSTDGFATTLTMRKLHLIWVTARMHIEIYKYPAWSDVVEIETWCQSEGRIGTRRDWILRDSATNEVIGRATSKWVMMNQDTRRLQRVTDEVRDEYLVFCPREPRLAFPEENNSSLKKIPKLEDPAQYSMLELKPRRADLDMNQHVNNVTYIGWVLESIPQEIIDTHELQVITLDYRRECQQDDIVDSLTTSEIPDDPISKLTGTNGSATSSIQGHNESQFLHMLRLSENGQEINRGRTQWRKKSSR

SEQ ID NO: 59 - DNA, 1561 bp, Carthamus tinctorius
  CDS (173)..(1339): Genbank accession number - M96569  encoding Acyl coa-acp thioesterase  - C. Tinctorius (Protein ID - Q42715)
gggtaacatggcataaacgtgaataactgcaactccagtgtcactttccctttcctttccaccaccatctcctccctcggtcccatcgacggcaaactccataaaaccaccaccacctcttcaaatcaacacctcttccgaaccaccaccaccaccaccgccgccggcaactatgctatcacgacctcttccgaccaccgccgcggcggcgaccacgacgacgaataattgcaatggcgtcaactcccgcggcgccttacctcattcccgatccgttggattcgcctcgattcggaaacgaagcaccggttccttatgcaattcgccgccgcggacggtggcgccggtgatggcggtgaggaccggtgagcaaccgaccggcgttgccgtcggattgaaggaggcggaggcggaggtggagaagagcctggcggatcggcttcggatggggagcttgacggaagatggattgtcgtataaggagaggttcatcataaggtgttatgaagtcgggattaataagactgcaactgttgaaaccattgctaatctattgcaggaggttggaggtaatcatgctcagagtgttggattttcaacagacggatttgccaccacgaccactatgcgaaaattgcatctcatatgggtgacttcgcgaatgcacattgaaatttacagataccccgcttggagtgatgtggttgaaatcgagacttggtgtcaaagtgaaggaaggattgggactagacgtgattggattatgaaagaccatgcgagtggtgaagtcattggaagggctacaagcaaatgggtgatgatgaacgaggatactagaagactccagaaagtcaacgatgacgtcagagacgaatatctcgttttttgtcccaagacaccaagattagcatttcctgaaaagaacactagcagcctgaagaaaatagcaaaactagaagaccccgccgaatattcgacgctagggcttgtgccaagaagagccgatctcgatatgaacaagcatgttaacaatgttacctacattggatgggttcttgagagcatcccacaagaagtcatcgacactcatgaactacaaacgattaccctagactaccggcgggaatgccagcatgacgacatagtcgattccctcacgagttccgagtcactactcgacgatgccgccatctcgaaactcgaaggaaccaacggatcttctgttcccaaaaaagacgaaacggatttgagccggtttttgcatttactacgatcatcgggcgatggtctcgaactaaataggggtcgcaccgagtggagaaagaaacccgcgaaaaaatgagcaacacccttcggtttgtttagcgtacccttttttgcgtgttttcaatccatttttcataattcgccttttagggtttcgccgtttttatgtagcgtatttgttgtagatggactaggttttcggattctcgaaccggataggtgctatctttatcttcctatgttttgcttgtagaatggtatgaataaactagtttcgaagtaatgtttttggtag

SEQ ID NO: 60 - protein, 389 aa, Carthamus tinctorius
MLSRPLPTTAAAATTTTNNCNGVNSRGALPHSRSVGFASIRKRSTGSLCNSPPRTVAPVMAVRTGEQPTGVAVGLKEAEAEVEKSLADRLRMGSLTEDGLSYKERFIIRCYEVGINKTATVETIANLLQEVGGNHAQSVGFSTDGFATTTTMRKLHLIWVTSRMHIEIYRYPAWSDVVEIETWCQSEGRIGTRRDWIMKDHASGEVIGRATSKWVMMNEDTRRLQKVNDDVRDEYLVFCPKTPRLAFPEKNTSSLKKIAKLEDPAEYSTLGLVPRRADLDMNKHVNNVTYIGWVLESIPQEVIDTHELQTITLDYRRECQHDDIVDSLTSSESLLDDAAISKLEGTNGSSVPKKDETDLSRFLHLLRSSGDGLELNRGRTEWRKKPAKK

SEQ ID NO: 61 - DNA, 1300 bp, Garcinia mangostana
  CDS (6)..(1064): Genbank accession number - U92876 encoding Acyl coa-acp thioesterase  (Protein ID - O04792)
ccaagatgttgaagctctcttcttcccgaagcccattggcccgcattcccacccggcccaggcccaactccattcctccccggataattgtggtttcctcctcatccagcaaggttaatccactcaaaacagaggcggtggtttcttcggggctggctgaccggctccggctgggcagcttgaccgaggacgggctttcgtataaggagaagttcatagtgagatgctatgaggttgggattaacaagaccgctactgttgagactattgccaacctcttgcaggaggttggatgcaatcacgcccaaagcgttggatattcgacgggtgggttttcgacaacccctaccatgagaaaattgcgtctgatatgggttactgctcgcatgcacatcgaaatctacaaatatccagcttggagtgatgtggtggaaatagagtcgtggggccagggtgaaggaaaaatcggaaccagacgtgattggattctgagagactatgccactggtcaagttattggccgagctactagcaagtgggtaatgatgaaccaagacaccaggcgacttcaaaaagtcgatgttgatgttcgtgatgagtacttggttcactgtccaagagaactcagattggcatttccagaggaaaataatagcagcttgaagaaaatttcaaaacttgaagatccttctcaatattcgaagctggggcttgtgcctagaagagcagatctggacatgaatcaacatgttaataatgtcacctatattggatgggtgttggagagcatgcctcaagaaatcattgatacccatgaactgcaaaccataacattagactacagacgggaatgccaacatgatgatgtggttgattccttgactagtccagagccttctgaagatgctgaagcagttttcaaccataatggaacaaatgggtctgcaaatgtgagcgccaacgaccatggatgccgcaactttctgcatctactaagattgtcgggcaatggacttgaaatcaaccgtggtcgtactgagtggagaaagaaacctacaagatgaggcaataaagtacattatgtactttatcgttgctttagccggcttctggatggtgatttctttctgcattccttctttcctttttgttttcctagggtatccttcgcttcttgcctgtaagagtattatgttttccgtttgccctgaagttgtaaatttgtcgaggaactcgagtcattgtttgaatcgaggatggtgagaagtgtacttgtttgttgtattccattcttcctgat

SEQ ID NO: 62 - protein, 352 aa, Garcinia mangostana
MLKLSSSRSPLARIPTRPRPNSIPPRIIVVSSSSSKVNPLKTEAVVSSGLADRLRLGSLTEDGLSYKEKFIVRCYEVGINKTATVETIANLLQEVGCNHAQSVGYSTGGFSTTPTMRKLRLIWVTARMHIEIYKYPAWSDVVEIESWGQGEGKIGTRRDWILRDYATGQVIGRATSKWVMMNQDTRRLQKVDVDVRDEYLVHCPRELRLAFPEENNSSLKKISKLEDPSQYSKLGLVPRRADLDMNQHVNNVTYIGWVLESMPQEIIDTHELQTITLDYRRECQHDDVVDSLTSPEPSEDAEAVFNHNGTNGSANVSANDHGCRNFLHLLRLSGNGLEINRGRTEWRKKPTR

SEQ ID NO: 63 - DNA, 1744 bp, Cuphea hookeriana
  CDS (206)..(1453): genbank accession number - U17076 encoding Acyl coa-acp thioesterase  (Protein ID - Q39513)
ctttgatcggtcgatcctttcctctcgctcataatttacccattagtcccctttgccttctttaaaccctcctttcctttctcttcccttcttcctctctgggaagtttaaagcttttgcctttctcccccccacaacctctttcccgcatttgttgagctgtttttttgtcgccattcgtcctctcctcttcagttcaacagaaatggtggctaccgctgcaagttctgcattcttccccctcccatccgccgacacctcatcgagacccggaaagctcggcaataagccatcgagcttgagccccctcaagcccaaatcgacccccaatggcggtttgcaggttaaggcaaatgccagtgcccctcctaagatcaatggttccccggtcggtctaaagtcgggcggtctcaagactcaggaagacgctcattcggcccctcctccgcgaacttttatcaaccagttgcctgattggagtatgcttcttgctgcaatcacgactgtcttcttggctgcagagaagcaatggatgatgcttgattggaaacctaagaggcctgacatgcttgtggacccgtttggattgggaagtattgttcaggatgggcttgtgttcaggcagaatttttcgattaggtcctatgaaataggcgccgatcgcactgcgtctatagagacggtgatgaaccatttgcaggaaacagctctcaatcatgttaagattgctgggctttctaatgacggctttggtcgtactcctgagatgtataaaagggaccttatttgggttgttgcgaaaatgcaagtcatggttaaccgctatcctacttggggtgacacggttgaagtgaatacttgggttgccaagtcagggaaaaatggtatgcgtcgtgactggctcataagtgattgcaatactggagagattcttacaagagcatcaagcgtgtgggtcatgatgaatcaaaagacaagaagattgtcaaaaattccagatgaggttcgaaatgagatagagcctcattttgtggactctcctcccgtcattgaagacgatgaccggaaacttcccaagctggatgagaagactgctgactccatccgcaagggtctaactccgaggtggaatgacttggatgtcaatcaacacgtcaacaacgtgaagtacatcgggtggattcttgagagtactccaccagaagttctggagacccaggagttatgttcccttactctggaatacaggcgggaatgtggaagggagagcgtgctggagtccctcactgctatggatccctctggagggggttatgggtcccagtttcagcaccttctgcggcttgaggatggaggtgagatcgtgaaggggagaactgagtggcggcccaagaatggtgtaatcaatggggtggtaccaaccggggagtcctcacctggagactactcttagaagggagccctgacccctttggagttgtgatttctttattgtcggacgagctaagtgaagggcaggtaagatagtagcaatcggtagattgtgtagtttgtttgctgctttttcacgatggctctcgtgtataatatcatggtctgtcttctttgtatcctcttcttcgcatgttccgggttgattcatacattatattctttctatttgtttgaaggcgagtagcgggttgtaattatttattttgtcattacaatgtcgtttaacttttcaaatgaaactacttatgtg

SEQ ID NO: 64 - protein, 415 aa, Cuphea hookeriana
MVATAASSAFFPLPSADTSSRPGKLGNKPSSLSPLKPKSTPNGGLQVKANASAPPKINGSPVGLKSGGLKTQEDAHSAPPPRTFINQLPDWSMLLAAITTVFLAAEKQWMMLDWKPKRPDMLVDPFGLGSIVQDGLVFRQNFSIRSYEIGADRTASIETVMNHLQETALNHVKIAGLSNDGFGRTPEMYKRDLIWVVAKMQVMVNRYPTWGDTVEVNTWVAKSGKNGMRRDWLISDCNTGEILTRASSVWVMMNQKTRRLSKIPDEVRNEIEPHFVDSPPVIEDDDRKLPKLDEKTADSIRKGLTPRWNDLDVNQHVNNVKYIGWILESTPPEVLETQELCSLTLEYRRECGRESVLESLTAMDPSGGGYGSQFQHLLRLEDGGEIVKGRTEWRPKNGVINGVVPTGESSPGDYS

SEQ ID NO: 65 - DNA, 1296 bp, Cuphea wrightii
  CDS (20)..(1216): Genbank accession number - U56103 encoding Acyl coa-acp thioesterase  (Protein ID - Q39662)
attttccctgccgacaaacatggtggctgccgcagcaagttctgcatttttctctgttccaaccccgggaacgtcccctaaacccgggaagttcggtaactggccatcgagcttaagcgtccccttcaagcccgacaatggtggctttcatgtcaaagcaaacgccagtgcccatcctaaggctaatggttctgcagtaaatctaaagtctggcagcctcgagactcctcctcggagtttcattaaccagctgccggacttgagtatgctactgtccaaaatcacgactgtcttcggggcagctgagaagcagtggaagaggcccggcatgctcgtggaaccgtttggggttgacaggatttttcaggatggtgtttttttcagacagagtttttctatcaggtcttacgaaataggcgttgatcgaacagcctcgatagagacactgatgaacatcttccaggaaacgtctctgaatcattgcaagagtatcggtcttctcaacgacggctttggtcgtactcctgagatgtgtaagagggacctcatttgggtggttacgaaaattcaggtcgaagtgaatcgctatcctacttggggtgatactattgaggtcaatacttgggtctcggagtcggggaaaaacggtatgggtcgggattggctgataagtgattgccggacaggagaaattcttataagagcaacaagcgtgtgggcgatgatgaatcaaaacacgagaagattgtcaaaatttccatatgaggttcgacaggagatagcgcctcattttgtggactctgctcctgtcattgaagacgatcgaaagttgcacaagcttgatgtgaagacaggtgattccattcgcgatggtctaactccgaggtggaatgacttggatgtcaatcaacacgttaacaatgtgaagtacattggatggattctcaagagtgttccaatagaagtattcgagacacaggagctatgcggcgtcacacttgaatataggcgggaatgcggaagggacagtgtgctggagtctgtgaccactatggatccagcaaaagagggagaccggtgtgtgtaccagcaccttcttcggcttgaggatggggctgatatcactataggcagaaccgagtggcggccgaagaatgcaggagccaatggtgcaatatcatcaggaaagacttcaaatggaaactctgtctcatagaaggaaggggttggcaacctttccgagttgtgcgtttaattttctgatgcaatcagtaaactgtgtagtttgtttcccac

SEQ ID NO: 66 - protein, 398 aa, Cuphea wrightii
MVAAAASSAFFSVPTPGTSPKPGKFGNWPSSLSVPFKPDNGGFHVKANASAHPKANGSAVNLKSGSLETPPRSFINQLPDLSMLLSKITTVFGAAEKQWKRPGMLVEPFGVDRIFQDGVFFRQSFSIRSYEIGVDRTASIETLMNIFQETSLNHCKSIGLLNDGFGRTPEMCKRDLIWVVTKIQVEVNRYPTWGDTIEVNTWVSESGKNGMGRDWLISDCRTGEILIRATSVWAMMNQNTRRLSKFPYEVRQEIAPHFVDSAPVIEDDRKLHKLDVKTGDSIRDGLTPRWNDLDVNQHVNNVKYIGWILKSVPIEVFETQELCGVTLEYRRECGRDSVLESVTTMDPAKEGDRCVYQHLLRLEDGADITIGRTEWRPKNAGANGAISSGKTSNGNSVS

SEQ ID NO: 67 - DNA, 1617 bp, Garcinia mangostana
  CDS (108)..(1328): Genbank Accession number - U92878 encoding Acyl coa-acp thioesterase  (Protein ID - O04794)
ttctcctctccaagtttggttcttctccgcgggtttctcgttggatccaccaccggagaagatcccgcggcttgaatttgtgatctgattggttaattgtggccacaatggttgctactgccgccacgtcatcattctttccgttgacttccccttctggggatgccaaatcgggcaatcccggaaaagggtcggtgagttttgggtcaatgaagtcgaaatccgcggcttcctcgaggggtttacaagtgaaggccaatgcacaggcacccactaagatcaatggatccacggatgatgctcaattgcctgccccgaggacttttattaaccagttgcctgattggagcatgcttcttgctgctattactaccgtgtttttggcagccgagaagcagtggatgatgttggattggaagcctaggaggcccgacatgcttattgacacgtttggtttggggaggattgtgcaggatggtcttgtttttcgacagaatttctcgattaggtcctatgaaattggtgctgatcgtactgcgtctatagagacggttatgaatcatctgcaagaaactgccctcaatcatgttaagactgcaggacttctgggtgatggattcggttcaacaccagagatgtctaaaaggaatctcatatgggttgttactaagatgcaggtcgaagtcgatcggtatcctacatggggtgacgttgttcaggtagatacttgggtgagtgcatcaggaaagaatggaatgcgtcgagattggcttcttcgtgatggtaatactggggagacattaaccagagcttcaagtgtgtgggtgatgatgaataaactgacaaggagattgtctaaaattcccgaagaagttcgggaggaaataggatcttactttgtgaattctgatcctgttgtggaggaggatggtagaaaggtgacaaaacttgatgacaacactgcagattttgttcgcaaagggttaactcctaaatggaatgacttggacatcaatcagcatgtgaataatgtgaagtatattggctggatccttgagagcgctccacagccaatcctggaaacccgtgagctctcagcggtgactttggagtataggagggagtgtggaagggacagtgtgctgcggtctctgaccgccgtttctggcggtggcgttggtgatttaggacacgctggtaacgtcgagtgccagcacgtgcttcgcttggaggatggagctgagattgttcgtggaaggaccgagtggaggcccaaatacattaacaacttcagtatcatgggccagattccgacagatgcttcttagtgctcatatttgcagcatctgcaatggtgatgctacaaatccaatgcatgtaggaaaatagtatcctgctttactttgcacatcttaagcctcattgtaaattagctcgtttgtctctcttcctccctttccccccccccctcaagagtggttgcttctggggaaaatgtttttgttttgcattagcctgtttaaatttggtgggacataatctattacttgcatcttctgctattctggtgtctgcaatttccaggacttgatatgtttaattggtttatattctttt

SEQ ID NO: 68 - protein, 406 aa, Garcinia mangostana
MVATAATSSFFPLTSPSGDAKSGNPGKGSVSFGSMKSKSAASSRGLQVKANAQAPTKINGSTDDAQLPAPRTFINQLPDWSMLLAAITTVFLAAEKQWMMLDWKPRRPDMLIDTFGLGRIVQDGLVFRQNFSIRSYEIGADRTASIETVMNHLQETALNHVKTAGLLGDGFGSTPEMSKRNLIWVVTKMQVEVDRYPTWGDVVQVDTWVSASGKNGMRRDWLLRDGNTGETLTRASSVWVMMNKLTRRLSKIPEEVREEIGSYFVNSDPVVEEDGRKVTKLDDNTADFVRKGLTPKWNDLDINQHVNNVKYIGWILESAPQPILETRELSAVTLEYRRECGRDSVLRSLTAVSGGGVGDLGHAGNVECQHVLRLEDGAEIVRGRTEWRPKYINNFSIMGQIPTDAS

SEQ ID NO: 69 - DNA, 1359 bp, Pichia pastoris
  CDS (1)..(1359): GeneID: 8196549; coordinates 1335356 to 1336714 encoding Acyl-coenzymeA:ethanol O-acyltransferase (Protein ID - C4QX24)
atgccatcttgggggttccataatcagattcatgctacctacagcgataaatcggtggcactcaagctgaagtctggcaagaacgactttgcacctttgaatgtcattcctttttctacatttattaagactttagtacctgaactcagcgatggctacaaattcaaccttcacccttttctgttcaatggcgctctccagactttatacgcgtccaaagctgactatagtaaagaatttcaaatatactatggaagatgcatggttcgatatcctgaggcaaatcatgagtatccacatttacatcttggtcaagcgactgcggattttgtagttgatccaccaacagaaatcgatgaatggaattatttatacaatcagactttacctgaaggatggcctcgattgcatccgcggactagattcctaacagtgcaagaagaacaagacctggaagctgactgggcctcaaactctggatcaattgttgtaattattcacggattggccggtggctcgcacgaaccgggaatacgagatgtgagccagcatcttcatcaagctggttttaatgttgtgacactcaactctcgtggatgttgtcgctctaaattgtcaacaggaagactttactcggccgtcgaaacagatgatctccgttactttattgatgagctacataagaaaatacccaacaagcctatctatcttttgggattttctttagggtctgcactggttctcaattatcttggcgaggaaggaaagaagagcttcatcaaaagtgcggtcactatcggagcacctgtagacctcctggactcccattatcatttgaaccacagttactctggaaagtatctattcgatcctgcagtggcttcattcttgtcaaatttggtaaaagttaacttcccaattctaaaccgtgataaaccggaagtattctcatacgaaaagaagtccaaagattacttggtacggagaatcgtcgactttgatcgaaaatatactgccccagcgtatggatttgcaagtccaaaatattactatcaagctggatctcccttaaccaagctagtaaatatttacactccaacagtactgctgaactccttagatgatccggtagtatcgtgtaatttaccagtggatgaagttaaagcaaacccatatctatatctagcggcctcagatttaggtggtcatttggcttatattcagtgggatggtggattctggtttagcgaagccgtgtctgcatacttcatggcatttgaatcggaactgtcaaacgaacctgcacaaagtgattacgagcctcagctaagtgaatacagctataaaactggaatttga

SEQ ID NO: 70 - protein, 452 aa, Pichia pastoris
MPSWGFHNQIHATYSDKSVALKLKSGKNDFAPLNVIPFSTFIKTLVPELSDGYKFNLHPFLFNGALQTLYASKADYSKEFQIYYGRCMVRYPEANHEYPHLHLGQATADFVVDPPTEIDEWNYLYNQTLPEGWPRLHPRTRFLTVQEEQDLEADWASNSGSIVVIIHGLAGGSHEPGIRDVSQHLHQAGFNVVTLNSRGCCRSKLSTGRLYSAVETDDLRYFIDELHKKIPNKPIYLLGFSLGSALVLNYLGEEGKKSFIKSAVTIGAPVDLLDSHYHLNHSYSGKYLFDPAVASFLSNLVKVNFPILNRDKPEVFSYEKKSKDYLVRRIVDFDRKYTAPAYGFASPKYYYQAGSPLTKLVNIYTPTVLLNSLDDPVVSCNLPVDEVKANPYLYLAASDLGGHLAYIQWDGGFWFSEAVSAYFMAFESELSNEPAQSDYEPQLSEYSYKTGI

SEQ ID NO: 71 - DNA, 1371 bp, Saccharomyces cerevisiae
  CDS (1)..(1371): GeneID: 856010; coordinates - 368068 to 369438 - minus strand encoding Acyl-coenzymeA:ethanol O-acyltransferase (Protein ID - Q02891)
atgtttcgctcgggttactatccaactgtcactcctagccattggggctataacggcaccgtcaaacatgtactgggagagaaaggaaccaagtctttggctttcagagattctaagcgccaaattcctcttcatgaattcgtaaccaaacacgtgcctacactcaaagatggtgcaaattttaggttaaacagcttgcttttcacaggttacttacagaccctttatttgtcagccggtgatttttccaaaaaatttcaggtattttatggaagagagattataaaattttctgatggaggggtctgcactgcagattgggttatgcctgaatgggagcaaacatattcattaaatgctgaaaaggctagttttaacgagaaacaattttcgaacgatgaaaaggccacccatccaaagggttggcctcgtcttcacccgagaactagatatctatcctctgaggaacttgaaaaatgtcattctaagggttattcttaccctttagtggtagtacttcatggtcttgcagggggaagccatgagcctctcatcagggcattatctgaagatctatcaaaagtcggtgacggtaaattccaagtggtagtccttaatgctagaggttgctcaagatctaaagtcaccacccgtagaatctttaccgcattacacacaggtgatgtgagagaatttttgaaccaccaaaaagctctatttccgcaaagaaaaatatatgcagtcggaacatcatttggagcagccatgctaacgaactacttaggtgaagaaggagataactgtccattaaatgctgcagtcgctctctcaaacccatgggatttcgtacacacttgggacaagttggctcatgattggtggtccaaccatattttttctagaactttaacacaatttctaacaaggactgtcaaggttaatatgaatgagttgcaggtaccagagaattttgaggtttcgcacaaaccgacagttgagaaaccagtcttttatacgtataccagagaaaatttggaaaaggctgaaaaatttacagacatattagaattcgataatcttttcactgccccatcgatgggcctgccggacgggttaacatattatagaaaggccagttcgataaatagattgcctaatatcaaaatcccaactttaataatcaacgcaacggatgatccagttacaggtgaaaacgtaattccgtacaaacaagctagagaaaatccttgtgtgttgttatgcgagactgacttgggtggacatttggcttatctcgacaatgaaagtaattcctggttaacaaagcaagctgccgagttcttgggcagctttgatgagttagttttataa

SEQ ID NO: 72 - protein, 456 aa, Saccharomyces cerevisiae
MFRSGYYPTVTPSHWGYNGTVKHVLGEKGTKSLAFRDSKRQIPLHEFVTKHVPTLKDGANFRLNSLLFTGYLQTLYLSAGDFSKKFQVFYGREIIKFSDGGVCTADWVMPEWEQTYSLNAEKASFNEKQFSNDEKATHPKGWPRLHPRTRYLSSEELEKCHSKGYSYPLVVVLHGLAGGSHEPLIRALSEDLSKVGDGKFQVVVLNARGCSRSKVTTRRIFTALHTGDVREFLNHQKALFPQRKIYAVGTSFGAAMLTNYLGEEGDNCPLNAAVALSNPWDFVHTWDKLAHDWWSNHIFSRTLTQFLTRTVKVNMNELQVPENFEVSHKPTVEKPVFYTYTRENLEKAEKFTDILEFDNLFTAPSMGLPDGLTYYRKASSINRLPNIKIPTLIINATDDPVTGENVIPYKQARENPCVLLCETDLGGHLAYLDNESNSWLTKQAAEFLGSFDELVL

SEQ ID NO: 73 - DNA, 1559 bp, Mus musculus
  CDS (9)..(1268): GeneID: 26897; coordinates - 85350452 to 85358620 encoding Cytosolic Acyl-CoA Thioesterase CTE1 from Mus muscilis - Protein ID - O55137
agctcgagatggaggcgacgctgaaccttgagccctcgggccgcagctgctgggacgaaccgctgagcatcgccgtgcgcggcctggccccggagcagcccgtcacgctgcgctctgtcctgcgcgacgagaagggcgcgctcttccgagcccacgcgcgctaccgcgcggactcccacggcgagctggacctggcgcgcacgcccgcgctgggcggcagcttctcggggctcgagcccatggggctgctctgggccatggagcccgatcggcctttttggcgattggtcaagcgcgacgtgcagacgcccttcgtggtggagctggaggtgctggacggacacgagcccgacggcgggcagcggcttgcacatgcggtgcacgagcgtcacttcttggctccgggggtgcggcgcgtgcccgtacgagagggccgggtgcgcgccacgctcttcctgcccccagaacctggaccctttcctgggatcatagacctttttggagttggaggtggccttctggagtatcgggcgagcctgctggctgggaagggctttgccgtcatggctctggcttattacaactacgatgacctccccaagaacatggaaaccatgcacatggagtactttgaagaagccgtgaactacctgcgcagccaccccgaggtaaaaggacctggaattgggctgcttgggatttccaaagggggtgaacttggccttgctatggcctccttcctgaagggcatcacagctgctgtggtcatcaatggctccgtggctgctgttgggaacaccatctcctacaaggatgagactataccccctgtgactatcctgagaaatcaggtcaaaatgaccaaggatggcctcaaggatgttgtagatgctttgcaaagccctctggtagacaagaagagcttcattcccgtggaaaggtctgacacgaccttcctgttcctcgtaggtcaggacgaccacaactggaagagcgagttctatgctgatgagatctccaaacgcctgcaggcgcacgggaaggagaagccccagatcatctgctacccagcagcagggcattacatcgagcccccttacttcccgctgtgcagcgctggcatgcacctcctggtgggtgccaacatcacctttggaggggagcccaagcctcatgccatggcccagttggatgcatggcagcagctccagactttcttccacaaacagttgggtagtgagtgtttgcatgtgtctcctaaaatataacctattatatgatggtttggaggttggggaaaggtacaaatacattgtaagaatatcatttcagatgacttcatctgaacataaaactgctttagatttacatttaaaaaaattgatataattatcaaaatagtgctgattcaagggctgggaatggagtttcattgtcaagtccttgactggcgcatgcaggatcctgggttcaatccagctgcgagaaataaagcacgttctatggaaactggagctatccaagaaaagtgccaggaataaaaaggaaccatgattaaa

SEQ ID NO: 74 - protein, 419 aa, Mus musculus
MEATLNLEPSGRSCWDEPLSIAVRGLAPEQPVTLRSVLRDEKGALFRAHARYRADSHGELDLARTPALGGSFSGLEPMGLLWAMEPDRPFWRLVKRDVQTPFVVELEVLDGHEPDGGQRLAHAVHERHFLAPGVRRVPVREGRVRATLFLPPEPGPFPGIIDLFGVGGGLLEYRASLLAGKGFAVMALAYYNYDDLPKNMETMHMEYFEEAVNYLRSHPEVKGPGIGLLGISKGGELGLAMASFLKGITAAVVINGSVAAVGNTISYKDETIPPVTILRNQVKMTKDGLKDVVDALQSPLVDKKSFIPVERSDTTFLFLVGQDDHNWKSEFYADEISKRLQAHGKEKPQIICYPAAGHYIEPPYFPLCSAGMHLLVGANITFGGEPKPHAMAQLDAWQQLQTFFHKQLGSECLHVSPKI

SEQ ID NO: 75 - DNA, 1515 bp, Arabidopsis thaliana
  CDS (33)..(1310): GeneID: 827955; coordinates - 227694 to 231699 encoding Cytosolic Acyl-CoA Thioesterase CTE1  (Protein ID - Q5FYU1)
ccggccaacgtttcgacagtctctacaccgtcatgaacactgaatcagttgtcgagttccttgggaatgtgaccttgttgcagcggttacctagttcctctctgaagagaatctccgaagtcgttgtcttcaaaggttatgacagaggtgattatgtggttcgtgaaaatcaaaatgtggatggagtttattttctcttgcaaggacaggctcaggttctgagatcagccggagaggaaaactatcaagagttccctttgaaacgatatgatttcttcggccatggtattttcggggatgtttactcagcagatgttgttgctgtgacagagcttacctgcttgctgttgatgtctgatcatcgtgctttacttgaaataaagtcagtctcggattcagataaggaacgctgtcttgtggaagacatactatatctagaaccattagatttgaatgtataccgggggttcaccccacctaatgctccaacctatggaaaggtttatggagggcaattagttggacaggcacttgccgcagcatcaaaaactgttgaaactatgaagatagtccataattttcattgctatttccttcttgttggagatataaatattcccatcatatatgatgttaaccgcttacgtgacggcaacaactttgccaccagaagtgtagatgctagacagaaaggaaaaactatattcaccttgttcgcgtcatttcagaaaaagcaacaaggttttattcaccaggagtcgaccatgcctcatacaccagctcctgaaacgcttctaccaagggaggagatgcttgaacggcttgttactgagcctctgctacctagggattaccgaaaccaagttgcaactgaaattagtgttccattccctatagatattcgattttgtgagccaaatcgttccactaaacagaataagtctcctccaagactaaaatattggtttagagcaaagggaaaactttctgatgatgatcaagctttgcacagatgtgtggttgcatttgcttccgatttgatattcgccactatcagtttaaaccctcaccggagagagggcatgagtgtagctgctcttagcctggaccactcgatgtggttccaccgacctgtaagagcagatgattggttgttgtttgtgatagtgagtccaactgcgaccgaaagccgcggttttgcaactggcaaaatgttcaacagaaagggagagctggtggtatcattgacgcaagaagctgtgttaagagaagctgtgactattaagccatccttcggggccaagctatgaagccataggattttgatagtgagagaattgctgcatctgttactcctcacggtcacattccaaagagtcgtcacttatactacatttgcatatgtttttcgatccacaattattattttcccctctaaaagggtctacacatatgtttgtttgtaaccacgataatgtttcaacagcaatgaaaaagcaaacagtggttcatttt

SEQ ID NO: 76 - protein, 425 aa, Arabidopsis thaliana
MNTESVVEFLGNVTLLQRLPSSSLKRISEVVVFKGYDRGDYVVRENQNVDGVYFLLQGQAQVLRSAGEENYQEFPLKRYDFFGHGIFGDVYSADVVAVTELTCLLLMSDHRALLEIKSVSDSDKERCLVEDILYLEPLDLNVYRGFTPPNAPTYGKVYGGQLVGQALAAASKTVETMKIVHNFHCYFLLVGDINIPIIYDVNRLRDGNNFATRSVDARQKGKTIFTLFASFQKKQQGFIHQESTMPHTPAPETLLPREEMLERLVTEPLLPRDYRNQVATEISVPFPIDIRFCEPNRSTKQNKSPPRLKYWFRAKGKLSDDDQALHRCVVAFASDLIFATISLNPHRREGMSVAALSLDHSMWFHRPVRADDWLLFVIVSPTATESRGFATGKMFNRKGELVVSLTQEAVLREAVTIKPSFGAKL

SEQ ID NO: 77 - DNA, 1497 bp, Rattus norvegicus
  CDS (387)..(1346): GeneID: 170588; coordinates - 155828209 to 155829862 - minus strand encoding Cytosolic Acyl-CoA Thioesterase CTE1  (Protein ID - Q6AZ44)
caagggcccaggtgtggcccggactgagtggcttattgggagcttgggaggagccggagaagagaccggtaacagcaacctgggggcgactttgctctgtgacagaagggaaatgacactcatcccttattattcatctccaatgctccgccccttcgctgattcacccaatcacacgcggatctcctaaactggcacaaatagtctccaatcttaaaatagatatggccacacccactcagaaattgacaagcacaacgaccaatcagaatctgcgtctcgcacacggaaaccctagggatttccggcccctggagcgacctgccggaagcgctgggtgcctatataagtttccgcgtttctctcatctgcagcaagcagtgaaaatgtcaaagccagaggacctaggagatgctaatggcgacgccgaccgcggcgacctttccggggacctgcgtagtgtgctggtcaccagcgtgctcaacctcgagcctctagatgaagatctctacagaggaaggcattactgggtacctacctcccagcggctctttgggggtcagattgtgggccaggctctggtggctgcagccaagtccgtgagtgaagacgtccacgtgcactccctgcactgctactttgtccgggcaggggacccaaaggtgccagtgctgtaccatgtggagaggacacgaacaggagcaagcttctcagtgcgtgcagtgaaggctgtgcagcatggcaaggccatcttcatctgccaggcctccttccagcagatgcagcccagccccctgcagcaccagttctccatgcccactgtgccccccccagaggagctgctggaccatgaggccctcattgaccagtacttaagggatcctaaccttcatgagaaatatcgagtggggctgaaccgaattgctgcccgagaggtgcctattgagatcaagctggtgaacccacccgccctgaaccagctgcagacactggagcccaaacagatgttctgggtgcgagcccggggctatattggggacggcgacatcaagatgcactgctgtgtggctgcttacatctctgactacgccttcctggggacggcactgctgcctcaccagtccaagtataaagtgaacttcatggtctcgctggaccactccatgtggttccacgccccattccgtgctgaccactggatgctctacgagtgtgagagcccctgggctggtggctctcgagggctggtacatgggcggctgtggcgtcgggatggggtccttgctgtgacctgtgcccaggagggtgtgatccgatcgaagcctcgggtatccgagagtaaactatagttggagattaactcgctcgcctggggctctaaggactctttctgctgccattcctttggcagaggtcacagttgagctgggcttcctgcctcttacatccaataaagagattgctaacactggaaaaaaaaaaaaaaaaaaaaaaaaa

SEQ ID NO: 78 - protein, 320 aa, Rattus norvegicus
MSKPEDLGDANGDADRGDLSGDLRSVLVTSVLNLEPLDEDLYRGRHYWVPTSQRLFGGQIVGQALVAAAKSVSEDVHVHSLHCYFVRAGDPKVPVLYHVERTRTGASFSVRAVKAVQHGKAIFICQASFQQMQPSPLQHQFSMPTVPPPEELLDHEALIDQYLRDPNLHEKYRVGLNRIAAREVPIEIKLVNPPALNQLQTLEPKQMFWVRARGYIGDGDIKMHCCVAAYISDYAFLGTALLPHQSKYKVNFMVSLDHSMWFHAPFRADHWMLYECESPWAGGSRGLVHGRLWRRDGVLAVTCAQEGVIRSKPRVSESKL

SEQ ID NO: 79 - DNA, 1047 bp, Saccharomyces cerevisiae
  CDS (1)..(1047): GeneID: 854068; coordinates - 159548 to 160594 encoding Alcohol dehydrogenase - (Protein ID - P00330)
atgtctatcccagaaactcaaaaaggtgttatcttctacgaatcccacggtaagttggaatacaaagatattccagttccaaagccaaaggccaacgaattgttgatcaacgttaaatactctggtgtctgtcacactgacttgcacgcttggcacggtgactggccattgccagttaagctaccattagtcggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaacaatacgctaccgctgacgctgttcaagccgctcacattcctcaaggtaccgacttggcccaagtcgcccccatcttgtgtgctggtatcaccgtctacaaggctttgaagtctgctaacttgatggccggtcactgggttgctatctccggtgctgctggtggtctaggttctttggctgttcaatacgccaaggctatgggttacagagtcttgggtattgacggtggtgaaggtaaggaagaattattcagatccatcggtggtgaagtcttcattgacttcactaaggaaaaggacattgtcggtgctgttctaaaggccactgacggtggtgctcacggtgtcatcaacgtttccgtttccgaagccgctattgaagcttctaccagatacgttagagctaacggtaccaccgttttggtcggtatgccagctggtgccaagtgttgttctgatgtcttcaaccaagtcgtcaagtccatctctattgttggttcttacgtcggtaacagagctgacaccagagaagctttggacttcttcgccagaggtttggtcaagtctccaatcaaggttgtcggcttgtctaccttgccagaaatttacgaaaagatggaaaagggtcaaatcgttggtagatacgttgttgacacttctaaataa

SEQ ID NO: 80 - protein, 348 aa, Saccharomyces cerevisiae
MSIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 81 - DNA, 1053 bp, Saccharomyces paradoxus
  CDS (1)..(1053): GeneID: 2538902; coordinates - 1591359 to 1592411 encoding Alcohol dehydrogenase  (Protein ID - P00332)
atgactattcctgacaagcagttggctgccgttttccacacccacggtggtcccgagaacgtcaagttcgaggaagtccccgtcgccgagcccggtcaagacgaggtcttggttaacatcaagtacaccggtgtctgccacaccgatttacacgctcttcaaggtgactggcctcttcccgccaagatgcctttgatcggtggtcacgaaggtgctggtgtcgtcgtcaaggtcggtgccggtgtcactcgtcttaagattggtgaccgtgttggtgtcaagtggatgaactcttcttgcggtaactgcgagtactgtatgaaggctgaggagaccatctgccctcacattcaactttccggttacaccgttgacggtactttccaacactactgcattgccaatgccacccatgctaccatcatccccgagtccgttcccctcgaggttgctgctcccatcatgtgcgctggtatcacttgctatcgtgccttgaaggaatccaaggtcggccctggtgagtggatctgcattcccggtgccggtggtggtcttggccatcttgccgtccaatacgccaaggctatggctatgcgtgttgttgccattgatactggtgatgacaaggctgagctcgtcaagtcctttggtgctgaggtcttccttgacttcaagaaggaagccgacatgattgaggctgtcaaggctgccaccaacggtggtgcccacggtaccttggtcttatccacctcccccaagtcttacgagcaagctgctggctttgcccgtcccggttccaccatggtcactgtttccatgcctgccggtgccaagctcggtgctgatatcttctggttgaccgttaagatgcttaagatctgcggttctcacgtcggtaaccgtattgactctatcgaggctcttgaatacgtttcccgtggtctcgtcaagccttactacaaggtccaacccttctctactcttcccgacgtctaccgtctcatgcatgagaacaagattgccggccgtatcgtcttggacctttccaagtaa

SEQ ID NO: 82 - protein, 350 aa, Saccharomyces paradoxus
MTIPDKQLAAVFHTHGGPENVKFEEVPVAEPGQDEVLVNIKYTGVCHTDLHALQGDWPLPAKMPLIGGHEGAGVVVKVGAGVTRLKIGDRVGVKWMNSSCGNCEYCMKAEETICPHIQLSGYTVDGTFQHYCIANATHATIIPESVPLEVAAPIMCAGITCYRALKESKVGPGEWICIPGAGGGLGHLAVQYAKAMAMRVVAIDTGDDKAELVKSFGAEVFLDFKKEADMIEAVKAATNGGAHGTLVLSTSPKSYEQAAGFARPGSTMVTVSMPAGAKLGADIFWLTVKMLKICGSHVGNRIDSIEALEYVSRGLVKPYYKVQPFSTLPDVYRLMHENKIAGRIVLDLSK

SEQ ID NO: 83 - DNA, 1053 bp, Aspergillus aculeatus
  CDS (1)..(1053): GeneID: 2868277; coordinates - 1591359 to 1592411 encoding Alcohol dehydrogenase  (Protein ID - C8VL73)
atgtccatccccactatgcaatgggcccaggtcgccgagaaggtcggcggcccgctcgtctacaagcagatccccgtccctaagcccggtcccgaccagatccttgtgaagatccgctactctggggtttgccacaccgacctacacgctatgatgggtcactggccaatccccgtcaaaatgccgctcgtcggtgggcacgaaggagcaggaatcgtcgtggcaaagggcgaactggtccacgaattcgagatcggcgaccaagctggcatcaaatggctcaatggttcctgcggagagtgcgagttctgccgccaatcggacgaccccctctgtgcacgcgcccagctctctgggtatactgttgacggcacgttccagcagtatgcgctcggaaaggcgagtcatgcgtcgaagatccctgcgggcgtcccgctggatgccgcggccccagtactctgtgccggtattacagtgtacaagggattgaaagaggccggggtccggccgggccagaccgtggcgatcgtgggtgccggtggcggcctgggatcccttgcacagcagtatgcgaaggcgatggggatcagggttgtcgcggtcgatgggggagatgagaagcgggccatgtgtgagtcgcttggaacagagacatatgtcgacttcaccaaatctaaagacctggtggccgacgtcaaggcagcgacgccggatggtctcggtgcgcacgcggtgatcctgcttgccgtgtcagagaagcccttccagcaagccactgaatatgtgcgctctcgcgggacaattgttgctattggcttgccgccagatgcgtacctcaaggcccctgtgatcaacacagttgttcgcatgatcactatcaagggcagctacgttggaaaccgacaggacggtgtcgaggctctggacttcttcgctcgcggcctgatcaaggctccgttcaagacggctcctctgaaggatctgccgaagatttacgagcttatggaacaaggcagaatcgccggtcgttatgtgctagagatgccagaataa

SEQ ID NO: 84 - protein, 350 aa, Aspergillus aculeatus
MSIPTMQWAQVAEKVGGPLVYKQIPVPKPGPDQILVKIRYSGVCHTDLHAMMGHWPIPVKMPLVGGHEGAGIVVAKGELVHEFEIGDQAGIKWLNGSCGECEFCRQSDDPLCARAQLSGYTVDGTFQQYALGKASHASKIPAGVPLDAAAPVLCAGITVYKGLKEAGVRPGQTVAIVGAGGGLGSLAQQYAKAMGIRVVAVDGGDEKRAMCESLGTETYVDFTKSKDLVADVKAATPDGLGAHAVILLAVSEKPFQQATEYVRSRGTIVAIGLPPDAYLKAPVINTVVRMITIKGSYVGNRQDGVEALDFFARGLIKAPFKTAPLKDLPKIYELMEQGRIAGRYVLEMPE

SEQ ID NO: 85 - DNA, 1056 bp, Saccharomyces cerevisiae
  CDS (1)..(1056): GeneID: 852442; coordinates - 533756 to 534811 encoding Alcohol Dehydrogenase 5 (ADH5) - S(Protein ID - P38113)
atgccttcgcaagtcattcctgaaaaacaaaaggctattgtcttttatgagacagatggaaaattggaatataaagacgtcacagttccggaacctaagcctaacgaaattttagtccacgttaaatattctggtgtttgtcatagtgacttgcacgcgtggcacggtgattggccatttcaattgaaatttccattaatcggtggtcacgaaggtgctggtgttgttgttaagttgggatctaacgttaagggctggaaagtcggtgattttgcaggtataaaatggttgaatgggacttgcatgtcctgtgaatattgtgaagtaggtaatgaatctcaatgtccttatttggatggtactggcttcacacatgatggtacttttcaagaatacgcaactgccgatgccgttcaagctgcccatattccaccaaacgtcaatcttgctgaagttgccccaatcttgtgtgcaggtatcactgtttataaggcgttgaaaagagccaatgtgataccaggccaatgggtcactatatccggtgcatgcggtggcttgggttctctggcaatccaatacgcccttgctatgggttacagggtcattggtatcgatggtggtaatgccaagcgaaagttatttgaacaattaggcggagaaatattcatcgatttcacggaagaaaaagacattgttggtgctataataaaggccactaatggcggttctcatggagttattaatgtgtctgtttctgaagcagctatcgaggcttctacgaggtattgtaggcccaatggtactgtcgtcctggttggtatgccagctcatgcttactgcaattccgatgttttcaatcaagttgtaaaatcaatctccatcgttggatcttgtgttggaaatagagctgatacaagggaggctttagatttcttcgccagaggtttgatcaaatctccgatccacttagctggcctatcggatgttcctgaaatttttgcaaagatggagaagggtgaaattgttggtagatatgttgttgagacttctaaatga

SEQ ID NO: 86 - protein, 351 aa, Saccharomyces cerevisiae
MPSQVIPEKQKAIVFYETDGKLEYKDVTVPEPKPNEILVHVKYSGVCHSDLHAWHGDWPFQLKFPLIGGHEGAGVVVKLGSNVKGWKVGDFAGIKWLNGTCMSCEYCEVGNESQCPYLDGTGFTHDGTFQEYATADAVQAAHIPPNVNLAEVAPILCAGITVYKALKRANVIPGQWVTISGACGGLGSLAIQYALAMGYRVIGIDGGNAKRKLFEQLGGEIFIDFTEEKDIVGAIIKATNGGSHGVINVSVSEAAIEASTRYCRPNGTVVLVGMPAHAYCNSDVFNQVVKSISIVGSCVGNRADTREALDFFARGLIKSPIHLAGLSDVPEIFAKMEKGEIVGRYVVETSK

SEQ ID NO: 87 - DNA, 1317 bp, Clostridium phytofermentas
  CDS (1)..(1317): GeneID: 5743318 - Coordinates - 1538568 to 1539884 encoding Xylose isomerase  (Protein ID - A9KN98)
atgaaaaattactttccaaatgttccagaagtaaaatacgaaggcccaaattcaacgaatccatttgcttttaaatattatgacgcaaataaagttgtagcgggtaaaacaatgaaagagcactgtcgttttgcattatcttggtggcatactctttgtgcaggtggtgctgatccattcggtgtaacaactatggatagaacctacggaaatatcacagatccaatggaacttgctaaggcaaaagttgacgctggtttcgaattaatgactaaattaggaattgaattcttctgtttccatgacgcagatattgctccagaaggtgatacttttgaagagtcaaagaagaatctttttgaaatcgttgattacatcaaagagaagatggatcagactggtatcaagttattatggggtactgctaataactttagtcatccaagatttatgcatggtgcttccacatcttgcaacgcagacgtatttgcatatgctgctgctaagattaagaatgcattagatgcaacaattaaattaggcggtaaaggttatgtattctggggtggtcgtgaaggttatgaaacacttcttaatacagatttaggacttgagcttgataatatggctagacttatgaagatggctgtagagtatggccgtgcaaatggttttgatggcgacttctatattgagccaaagccaaaggaaccaaccaagcatcaatatgattttgatacagcaaccgtacttgctttccttcgcaaatatggcttagaaaaagatttcaagatgaacattgaagcaaaccatgctactcttgcaggtcatacctttgaacatgaacttgcaatggctagagttaatggtgcatttggttctgtagatgcaaaccagggtgatccaaaccttggatgggatacggatcaattcccaactgatgttcatagtgcaactcttgcaatgcttgaagtacttaaggctggtggattcactaacggcggacttaactttgatgcaaaggtaagacgtggttccttcgaatttgatgatattgcatacggttatattgcaggaatggatacttttgcacttggtttaattaaggctgctgagattatcgacgatggtagaatcgcaaaatttgtagatgatcgttatgcaagctataaaacaggaattggtaaagcaattgtggatggaactacatctcttgaagaattagagcagtatgttttaacacatagtgaaccagtaatgcagagtggtcgtcaggaagttcttgaaacaatcgtaaataatattttatttagataa

SEQ ID NO: 88 - protein, 438 aa, Clostridium phytofermentas
MKNYFPNVPEVKYEGPNSTNPFAFKYYDANKVVAGKTMKEHCRFALSWWHTLCAGGADPFGVTTMDRTYGNITDPMELAKAKVDAGFELMTKLGIEFFCFHDADIAPEGDTFEESKKNLFEIVDYIKEKMDQTGIKLLWGTANNFSHPRFMHGASTSCNADVFAYAAAKIKNALDATIKLGGKGYVFWGGREGYETLLNTDLGLELDNMARLMKMAVEYGRANGFDGDFYIEPKPKEPTKHQYDFDTATVLAFLRKYGLEKDFKMNIEANHATLAGHTFEHELAMARVNGAFGSVDANQGDPNLGWDTDQFPTDVHSATLAMLEVLKAGGFTNGGLNFDAKVRRGSFEFDDIAYGYIAGMDTFALGLIKAAEIIDDGRIAKFVDDRYASYKTGIGKAIVDGTTSLEELEQYVLTHSEPVMQSGRQEVLETIVNNILFR

SEQ ID NO: 89 - DNA, 1320 bp, Yeshinia pestis
  CDS (1)..(1320): GeneID: 1176874; coordinates - 4553844 to 4555163 encoding Xylose Isomerase (Protein ID - Q8Z9Z1)
atgcaatcttattttaatgaattagaacaagtgcgctacgaaggtagccagagcacgaatcctctggcgtttcatcattacaacccggatgaaatgatccttggtaagcgaatggctgaccatctgcggtttgccgcctgttactggcataccttctgctggggtggggccgatatgttcggtgccaatgcttttgatcgcccatggcaacaacctggggatgcactggctctggctaaacgcaaagccgaggttgcatttgaattcttccataaactgaatgtaccgtattactgcttccatgatgtggatgtctcgccagaaggcgcgtcactacaggaatatctgaataacttcgccgtaatgaccgatgtactggctgaaaaacaagcagccagtggtgtgaaattattatggggcacggctaactgctttacccatcctcgttatggtgctggtgccgcgaccaatcctgatccagaagtatttagctgggcagccacccaggtctttacggccatgaatgccacccgccaactcggcggtgaaaactatgtgttatggggcggacgtgaaggctacgaaacactgttgaataccgatttgcgacaagagcgtgaacaaattggccgctttatgcaaatggtcgtcgaacataaacacaaaacgggtttccaggggacactccttattgagccaaaaccgcaggagcccactaaacatcaatacgattatgacgtcgcgacagtttacggcttccttaagcagttcggcttagaaaaagagattaaagtcaatattgaagccaaccatgccacgctggcggggcactctttccatcacgaaattgccagtgccatcgccttaggtatttttggctcagtggatgctaaccggggcgatccgcaactgggctgggataccgatcaattcccaaacagtgtagaagaaaatacactggtgatgttcgagatcctcaaagcaggcggttttaccaccgggggcctgaattttgatgccaaagtgcgccgccaaagtaccgataaatatgatctgttctacggtcatattggcgcaatggacaccatggcactggcgctaaaatttgccgccaaaatgattgaagatgggcaattagatcagatcgttgccaaacgttatgccggttggaatagcgagctgggccaacagatcctgcaaggtaaaatgtcgctggaagagctctcccgctatgccagtcaacataatctgaacccgcagcaccaaagcggtcatcaagagttgttggagaataaggttaaccgctatttatttggttga

SEQ ID NO: 90 - protein, 439 aa, Yeshinia pestis
MQSYFNELEQVRYEGSQSTNPLAFHHYNPDEMILGKRMADHLRFAACYWHTFCWGGADMFGANAFDRPWQQPGDALALAKRKAEVAFEFFHKLNVPYYCFHDVDVSPEGASLQEYLNNFAVMTDVLAEKQAASGVKLLWGTANCFTHPRYGAGAATNPDPEVFSWAATQVFTAMNATRQLGGENYVLWGGREGYETLLNTDLRQEREQIGRFMQMVVEHKHKTGFQGTLLIEPKPQEPTKHQYDYDVATVYGFLKQFGLEKEIKVNIEANHATLAGHSFHHEIASAIALGIFGSVDANRGDPQLGWDTDQFPNSVEENTLVMFEILKAGGFTTGGLNFDAKVRRQSTDKYDLFYGHIGAMDTMALALKFAAKMIEDGQLDQIVAKRYAGWNSELGQQILQGKMSLEELSRYASQHNLNPQHQSGHQELLENKVNRYLFG

SEQ ID NO: 91 - DNA, 2130 bp, Saccharomyces cerevisiae
  CDS (1)..(2130): - GeneID: 856353; coordinates - 36377 to 38506 (minus strand) encoding Glycerol Kinase  (Protein ID - P32190)
atgtttccctctctcttccgacttgtagtattctccaaacgttacatattccgatcaagccagcgcctttacactagtttaaaacaagaacagagccgtatgtccaaaataatggaagatttacgaagtgactacgtcccgcttatcgccagtattgatgtaggaacgacctcatccagatgcattctgttcaacagatggggccaggacgtttcaaaacaccaaattgaatattcaacttcagcatcgaagggcaagattggggtgtctggcctaaggagaccctctacagccccagctcgtgaaacaccaaacgccggtgacatcaaaaccagcggaaagcccatcttttctgcagaaggctatgccattcaagaaaccaaattcctaaaaatcgaggaattggacttggacttccataacgaacccacgttgaagttccccaaaccgggttgggttgagtgccatccgcagaaattactggtgaacgtcgtccaatgccttgcctcaagtttgctctctctgcagactatcaacagcgaacgtgtagcaaacggtctcccaccttacaaggtaatatgcatgggtatagcaaacatgagagaaaccacaattctgtggtcccgccgcacaggaaaaccaattgttaactacggtattgtttggaacgacaccagaacgatcaaaatcgttagagacaaatggcaaaacactagcgtcgataggcaactgcagcttagacagaagactggattgccattgctctccacgtatttctcctgttccaagctgcgctggttcctcgacaatgagcctctgtgtaccaaggcgtatgaggagaacgacctgatgttcggcactgtggacacatggctgatttaccaattaactaaacaaaaggcgttcgtttctgacgtaaccaacgcttccagaactggatttatgaacctctccactttaaagtacgacaacgagttgctggaattttggggtattgacaagaacctgattcacatgcccgaaattgtgtcctcatctcaatactacggtgactttggcattcctgattggataatggaaaagctacacgattcgccaaaaacagtactgcgagatctagtcaagagaaacctgcccatacagggctgtctgggcgaccaaagcgcatccatggtggggcaactcgcttacaaacccggtgctgcaaaatgtacttatggtaccggttgctttttactgtacaatacggggaccaaaaaattgatctcccaacatggcgcactgacgactctagcattttggttcccacatttgcaagagtacggtggccaaaaaccagaattgagcaagccacattttgcattagagggttccgtcgctgtggctggtgctgtggtccaatggctacgtgataatttacgattgatcgataaatcagaggatgtcggaccgattgcatctacggttcctgattctggtggcgtagttttcgtccccgcatttagtggcctattcgctccctattgggacccagatgccagagccaccataatggggatgtctcaattcactactgcctcccacatcgccagagctgccgtggaaggtgtttgctttcaagccagggctatcttgaaggcaatgagttctgacgcgtttggtgaaggttccaaagacagggactttttagaggaaatttccgacgtcacatatgaaaagtcgcccctgtcggttctggcagtggatggcgggatgtcgaggtctaatgaagtcatgcaaattcaagccgatatcttaggtccctgtgtcaaagtcagaaggtctccgacagcggaatgtaccgcattgggggcagccattgcagccaatatggctttcaaggatgtgaacgagcgcccattatggaaggacctacacgatgttaagaaatgggtcttttacaatggaatggagaaaaacgaacaaatatcaccagaggctcatccaaaccttaagatattcagaagtgaatccgacgatgctgaaaggagaaagcattggaagtattgggaagttgccgtggaaagatccaaaggttggctgaaggacatagaaggtgaacacgaacaggttctagaaaacttccaataa

SEQ ID NO: 92 - protein, 709 aa, Saccharomyces cerevisiae
MFPSLFRLVVFSKRYIFRSSQRLYTSLKQEQSRMSKIMEDLRSDYVPLIASIDVGTTSSRCILFNRWGQDVSKHQIEYSTSASKGKIGVSGLRRPSTAPARETPNAGDIKTSGKPIFSAEGYAIQETKFLKIEELDLDFHNEPTLKFPKPGWVECHPQKLLVNVVQCLASSLLSLQTINSERVANGLPPYKVICMGIANMRETTILWSRRTGKPIVNYGIVWNDTRTIKIVRDKWQNTSVDRQLQLRQKTGLPLLSTYFSCSKLRWFLDNEPLCTKAYEENDLMFGTVDTWLIYQLTKQKAFVSDVTNASRTGFMNLSTLKYDNELLEFWGIDKNLIHMPEIVSSSQYYGDFGIPDWIMEKLHDSPKTVLRDLVKRNLPIQGCLGDQSASMVGQLAYKPGAAKCTYGTGCFLLYNTGTKKLISQHGALTTLAFWFPHLQEYGGQKPELSKPHFALEGSVAVAGAVVQWLRDNLRLIDKSEDVGPIASTVPDSGGVVFVPAFSGLFAPYWDPDARATIMGMSQFTTASHIARAAVEGVCFQARAILKAMSSDAFGEGSKDRDFLEEISDVTYEKSPLSVLAVDGGMSRSNEVMQIQADILGPCVKVRRSPTAECTALGAAIAANMAFKDVNERPLWKDLHDVKKWVFYNGMEKNEQISPEAHPNLKIFRSESDDAERRKHWKYWEVAVERSKGWLKDIEGEHEQVLENFQ

SEQ ID NO: 93 - DNA, 165 bp, Saccharomyces cerevisiae
  misc_structure (1)..(165): FAA2 deletion upstream flank primer
cagctatgaccatgattacgggagtcaaaacgagggaactcaatattaattgcggagttgagcgatgatgggttggaactatataaagcatcggaaacgcatggctaagggaagtggaagaatgcaggttacaaaaaacggataagaacaaacttgtttcgaaat

SEQ ID NO: 94 - DNA, 81 bp, Saccharomyces cerevisiae
  misc_structure (1)..(81): FAA2 deletion downstream flank primer
gtacttatgacgatttggaacacattcaaactagaaaaaactttgatgtaggatatcccttttttgatcgggtaataactg

SEQ ID NO: 95 - DNA, 19 bp, Saccharomyces cerevisiae
  misc_structure (1)..(19): URA3 upstream flank fw primer
gaccatgattacgaattag

SEQ ID NO: 96 - DNA, 20 bp, Saccharomyces cerevisiae
  misc_structure (1)..(20): URA3 upstream flank rv primer
cttcaaaccgctaacaatac

SEQ ID NO: 97 - DNA, 20 bp, Saccharomyces cerevisiae
  misc_structure (1)..(20): FAA2 amplification fw primer
atggccgctccagattatgc

SEQ ID NO: 98 - DNA, 20 bp, Saccharomyces cerevisiae
  misc_structure (1)..(20): FAA2 amplification rv primer
tgcaaaaatcagaatggggg

SEQ ID NO: 99 - DNA, 21 bp, Saccharomyces cerevisiae
  misc_structure (1)..(21): SWA3 upstream of ACC1
cacaattgttatcggttctac

SEQ ID NO: 100 - DNA, 41 bp, Saccharomyces cerevisiae
  misc_structure (1)..(41): SWA4
gcagggatgcggccgctgaccttgctctgaatctgaattcc

SEQ ID NO: 101 - DNA, 36 bp, Saccharomyces cerevisiae
  misc_structure (1)..(36): Direct repeat 1 and KI URA3  - SWA 5
gtcagcggccgcatccctgcttcggcttcatggcaa

SEQ ID NO: 102 - DNA, 25 bp, Saccharomyces cerevisiae
  misc_structure (1)..(25): SWA 6 primer
gagcaatgaacccaataacgaaatc

SEQ ID NO: 103 - DNA, 25 bp, Saccharomyces cerevisiae
  misc_structure (1)..(25): Direct repeat 2 and Kl URA3 SWA7 primer
cttgacgttcgttcgactgatgagc

SEQ ID NO: 104 - DNA, 36 bp, Saccharomyces cerevisiae
  misc_structure (1)..(36): SWA 8 primer
cacggcgcgcctagcagcggtaacgccagggttttc

SEQ ID NO: 105 - DNA, 43 bp, Saccharomyces cerevisiae
  misc_structure (1)..(43): TEF1 promoter - SWA9 primer
cgctgctaggcgcgccgtgcacacaccatagcttcaaaatgtt

SEQ ID NO: 106 - DNA, 44 bp, Saccharomyces cerevisiae
  misc_structure (1)..(44): SWA10 primer
aataagctttcttcgctcattttgtaattaaaacttagattaga

SEQ ID NO: 107 - DNA, 44 bp, Saccharomyces cerevisiae
  misc_structure (1)..(44): Downstream of ACC1 - SWA11 primer
atgagcgaagaaagcttattcgagtcttctccacagaagatgga

SEQ ID NO: 108 - DNA, 20 bp, Saccharomyces cerevisiae
  misc_structure (1)..(20): SWA12 primer
tctcggaggcgtgaccccag

SEQ ID NO: 109 - DNA, 45 bp, Saccharomyces cerevisiae
  misc_structure (1)..(45): PflA fw primer
ccttgaattcgcggccgcatctagaatgtcagttattggtcgcat

SEQ ID NO: 110 - DNA, 49 bp, Saccharomyces cerevisiae
  misc_structure (1)..(49): PflA reverse primer
aaggactagtttagaacattaccttatgaccgtactgctcaagaatgcc

SEQ ID NO: 111 - DNA, 46 bp, Saccharomyces cerevisiae
  misc_structure (1)..(46): PflB forward primer
ccttgaattcgcggccgcatctagaatgtccgagcttaatgaaaag

SEQ ID NO: 112 - DNA, 52 bp, Saccharomyces cerevisiae
  misc_structure (1)..(52): PflB reverse primer
aaggactagtttacatagattgagtgaaggtacgagtaataacgtcctgctg

SEQ ID NO: 113 - DNA, 421 bp, Saccharomyces cerevisiae
  promoter (1)..(421): Yeast TEF1 promoter
tagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaacaatatcaat

The invention claimed is:

1. A genetically modified microorganism for the extracellular production of free fatty acids and esters thereof, wherein said microorganism characterised by:
   a. reduced fatty acyl-coA synthetase activity conferred by a FAA2 gene deletion;
   b. enhanced acetyl CoA carboxylase expression conferred by a recombinant endogenous ACC1 gene wherein said gene is operably linked to a heterologous promoter; and
   c. a transgene encoding a pyruvate formate lyase comprising PflA and PflB, wherein said microorganism is selected from among species of *Aspergillus nidulans, Candida tropicalis, Saccharomyces cerevisiae, Schizosacchromyces pombe,* and *Yarrowia lipolytica.*

2. The genetically modified microorganism of claim 1, further characterised by a transgene encoding an acyl CoA-ACP thioesterase, wherein said thioesterase is selected from among: Soyabean (*Glycine max*); *Chlamydomonas reinhardtii* (SEQ ID NO:53); *Arabidopsis thaliana* (SEQ ID NO: 54); *Ricinus communis* (SEQ ID NO: 56); *Triticum aestivum*; CtFatA from *Brassica napus* (SEQ ID NO: 58)); CtFatA from *C. tinctorius* (SEQ ID NO: 60); GmFatA1 from *G. mangostana* (SEQ ID NO: 62); CwFatB1 from *C. hookeriana*; (SEQ ID NO: 64); CwFatB1 from *C. wrightii* (SEQ ID NO: 66); GmFatB1 from *G. Mangostana* (SEQ ID NO: 68).

3. The genetically modified microorganism of claim 2, further characterised by enhanced expression of an acyl-coenzymeA:ethanol O-acyltransferase conferred by:
   a. a recombinant endogenous acyl-coenzymeA:ethanol O-acyltransferase (EEB1) gene wherein said gene is operably linked to a heterologous promoter.

4. The genetically modified microorganism of claim 3, further characterised by a transgene encoding a heterologous cytosolic Acyl CoA thioesterase (CTE-1), wherein said CTE-1 is selected from among: *Mus muscilis* (SEQ ID NO: 74); *Arabidopsis thaliana* (SEQ ID NO: 76) or *Rattus norvegicus* (SEQ ID NO: 78).

5. The genetically modified microorganism of claim 4, further characterised by one or more transgene encoding a heterologous glycerol kinase or a xylose isomerase or both; wherein said glycerol kinase is selected from among Glycerol Kinase from *Saccharomyces cerevisiae* (SEQ ID NO: 92), and said xylose isomerase is selected from among Xylose isomerase from *Clostridium phytofermentas* (SEQ ID NO: 88); *Yersinia pestis*—(SEQ ID NO: 90).

6. The genetically modified microorganism of claim 5, further characterised by deletion of an endogenous formate dehydrogenase FDH gene wherein said FDH gene is selected from among: (SEQ ID NO: 44); (SEQ ID NO: 46); (SEQ ID NO: 48).

7. The genetically modified microorganism of claim 6, further characterized by a transgene encoding a heterologous formate hydrogen lyase, wherein said lyase is *E. coli* formate hydrogen lyase (SEQ ID NO: 51).

8. The genetically modified microorganism of claim 7, further characterised by the deletion of an endogenous alcohol dehydrogenase (ADH) gene, wherein said ADH gene is selected from among: (SEQ ID NO: 79); (SEQ ID NO: 81); (SEQ ID NO: 83); and (SEQ ID NO: 85).

9. A method for the extracellular production of free fatty acids and esters thereof, comprising the steps of:
   a. introducing the genetically modified microorganism of claim 1 into a growth medium to produce a culture;
   b. incubating said culture, wherein the growth medium in said culture is aerated with oxygen;
   c. further incubating said culture after step (b) in the absence of an oxygen supply;
   d. recovering an extracellular phase comprising free fatty acids and esters from said culture;

wherein said microorganism is a yeast or fungal strain further characterized in that the genetic modification of said microorganism results in enhanced production of fatty acids and their esters of shorter chain length.

10. The method of claim 9, wherein the microorganism is *Candida tropicalis.*

11. The method of claim 10, wherein the growth medium comprises a carbon source selected from at least one of glucose, glycerol, xylose, hydrolysed cellulose and hemicellulose, starch, sugar alcohol, and xylan.

12. The method of claim 11, wherein the growth medium comprises or consists of the following components:

| Component | Composition (per litre medium) |
|---|---|
| Carbon Source | |
| carbon source | ≥50 g |
| Nitrogen Source | |
| Ammonium sulphate | 5 g |
| Vitamins* | |
| Biotin | 20 µg |
| Folic acid | 2 µg |
| Inositol | 10 mg |
| Niacin | 400 µg |
| Riboflavin | 200 µg |
| Pyridoxine hydrochloride | 400 µg |
| Thiamine hydrochloride | 400 µg |
| Compounds supplying trace elements | |
| Boric acid | 500 µg |
| Copper sulphate | 40 µg |
| Potassium iodide | 100 µg |
| Ferric chloride | 200 µg |
| Manganese sulphate | 400 µg |
| Sodium molybdate | 200 µg |
| Zinc sulphate | 400 µg |
| Salts | |
| Potassium phosphate monobasic | 900 mg |
| Potassium phosphate dibasic | 200 mg |
| Magnesium sulphate | 500 mg |
| Sodium chloride | 100 mg |
| Calcium chloride | 100 mg. |

13. A genetically engineered yeast or fungal strain characterised by:
   a. reduced fatty acyl-coA synthetase activity conferred by a FAA2 gene deletion;
   b. enhanced acetyl CoA carboxylase expression conferred by a recombinant endogenous ACC1 gene wherein said gene is operably linked to a heterologous promoter, and
   c. a transgene encoding a pyruvate formate lyase comprising PflA and PflB wherein said yeast or fungal strain is selected from among species of *Aspergillus nidulans, Candida tropicalis, Saccharomyces cerevisiae, Schizosacchromyces pombe,* and *Yarrowia lipolytica,* characterised in that the genetic modification of the yeast or fungal strain results in enhanced production of fatty acids and their esters of shorter chain.

14. The genetically engineered yeast or fungal strain of claim 13, where the yeast or fungal strain is *Candida tropicalis.*

* * * * *